United States Patent 10,900,036 (RNA INTERACTOME OF POLYCOMB REPRESSIVE COMPLEX 1 (PRC1)) - sequence listing, part 8

SEQ ID NO: 15538 - DNA, 1165 bp, Homo sapiens
tagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaacta

SEQ ID NO: 15539 - DNA, 1451 bp, Homo sapiens
tgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctt

SEQ ID NO: 15540 - DNA, 6744 bp, Homo sapiens
agtgttgcctagagcagtgggtaatagcattaacaataaaagcaaagaagtctgattagatacgatggtttttaaagaaatcaatttaaaaaaaaagatagttccacaatatttttgtaagtaaatgatgtgtgtcattcatattgacacaggatttattctgcacctgtgttatatatagttatctgtaagttcgtacagcttgctcatttatattcaaccatttaactattttaaattcctctttaatggtaataatatatttcataaatgcccataaagtggttgattgtggtttaaccatattagtgattgatttaatgtacattttatgtaagatagcatagtattgctaataatagaaacttaaaaatgttttaatttaggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggttagtttaatagattttaattaggacactcagacatgttataacataaagaaactgacacatttgattaatataccaaaaatgtattcttaatcatttcaagactttagggaaactttctgaattaaaaagcatgcaaagataaaacatgtctacctttaaaatcaccaatgtattgcgtgttccttccggttgtatacaatcctacaaaattgatgttggagaaaattaaccagagcatgctttgcacctttatttaagaatgtctggcttcagggtttctaaaggagcatctgaattagagaaaagaggcaggagggaggttttatggtccttaggagagaggaacgatgtctgcaaaagtcaactggttgggggatgggtgaattattctttcaaattagcaatcattatttggacaacttggattttgtcatgagggttggagaggagcatttagaggccaaagttatgttcaaaagaagattggggaaaaacagctgtggcggataaagggatgcaagggcaacagtggaaaattctcagcccttaagtgtctcttacaagacacaggcctggtagaaacattttcctttgtccgtgacacttgttccaagtcagctggactggcatactccattggaaggttgggatgaagtttaaaatgttgccatagcacataaaaaattactaaaataagaagagcctggacagagataatactgtacagagaaatggaggacaccttcaactaacttcaattgtcccctccttcccactccccacatacaaatggagtatttccatgaagaatttctcagttcagtttttattcttcccagaactagctttaggcttaaggctactattgttcctgtagcataactcatcaatagcattttggactgctgatggaaaggtgaagttaatatcaaattgttgtgtcttcattactaaagatactttctctgctactattaaaattgactttagtttatatcagccaaaaaagcaatggaagatttttagctaccatacctctaactgattatattaggtattgaatctaaacacctcagtaatattgaaaaattcagtaagtttaaaaaatgtttgaacccaaagtgattttcatatacactgaacatccacacccttgactactgggtccatcatcttgaattttctgtctttattaaaccacgtattcaactataatcagataatatgccctaatttgatgcccagaagataagtttacataacttcttgaaatttaagagattatctgactcgagaatgtactgaaagtatgaaataaaaggcactggttagaacagtcaagtctccttcagtttatatcaatactttagtaacactagagggttagttttgcagtatctcccttgccccacatcaagcacgcacacacagaagactcaatgtcagtatttgaaaattctcattatctaggatgacgtttgggtgtttgaatgctgtagtgtgtttaaaattaacttagctgtcaaagaagattagttttttcatagatactctcacatgatgtaagtgaaagaaccacaaaaatgttaagcactaacaaattgagactagaagcatttaacaaagtaatttgaaagccctttcgcatgatgggagtgtgtgctcttcacctcatggaagatgttaataatcactgcaagagttggttcatgctggaactgagcactttctacagggatttgtatcagttaaacagttatttcccttcacctgtgattaaaatgaactgagcagaggtttttgttgttgttcctgccatatatttgttaagatagggaacattactgaattatgccagtatttcttgatccactcagaagaagaaaaattcttttgcaaatgattaagctttttatatagcaactgttgacttttatgatgttcagatttgagtaagtaggagatttgactagatgaccattaagtttcatcaaattctgagttactgtgatttttaaatggagggaagaagtagaattacatctgttccatacaacagactgacatttagacaactcttctgtagcagcctcataaagttaaaaagaggctggataattcagagtcagtagagcgtttccaaataataaccaactcaatgggaattgtgcaataagcactgaatgtctcctaaggcttttgttcaaaatgaaacatcccatatctgattgctgcattgctgactgttgcaattacttccatcaggcaatgactgtagggtcttgtttaaatttcttctttggaaagggtttgtgaaatttcttgtctttgtgacctgtggtcaccctgttccctctactgcctagcagctcattgggtgcctgtgtcagcacagtccgtgaaagatgtctctgaagccatcttattggaattactgatgggttccatttctttatatttcatcttgcattttaaaatgatattgagtgagactccagacctgcacagattatctgctcagtgtgtttagggtaactttagaaaacgcataatctttaacatgtctttttcttagatatttgagataatgaaatactatttttgaattagtcatgtctcctagggaattgttccaggaaacaatttttttttttttttttttttgagatggaatctcactctgtcacccaggctggagtgcagtggtgcgaccttggctcactgcaatctctgcctcccgggttcaagtgattctcctgcctcagcctccccagtagctgggacttcaggtgtgcacccccacacccagctaatttttgtatttttagtagggacggggtttcactatgttggccagggtggtcttgaactcctgacctcaggtgatctgcccacctcagcctcccagagtgctaggattacaggtgtgagccactgtgcccggccgggaaacaattattaacatagaaagtcgtctgtaagactcagtataaaagtcttttgatgaaattgaagcttgttgagctggaagagttaccaggaagtctgatagccaggccctgattgttgttatcaggttcagtgttacatattcaagcgtgatattttaaaataagttgattaatgcttgaactattacattatcttatttaatttatttgacaataagggtgaatgccatagtgctatcatctttttactctcttcactaacaactcaagttttcatttgaaggcgtatataaggaagtcactggaagttttcccaccatttttcccactccatattggaaactatgccttgactttgagtggtgttggatatggtggcgattggtcggtcgtatgtgaaggctgaatgaactttcttagttggtggttggcctacctggcctggaattatttacgctgttaatttataacttttgtcttgtctgcatctcttaagcatattgctctctcccatttacctcaactttatgaggaatatgacactaaaacaactctaagactacattttattgtttttaaatgtccactaatacccatgatgctgagaatgaactggcatgataagtatcaaactctgtggtatttttaaaaatcatatttctctctccagagacctccacaacattgtattaaagttgttgtgagtatgtgagtattttattttctaggtgcatcctggtgagtttctagaaaataatcctttataaatgaataaggattcagaaattattgtttaaggagatactaatactttattttcacatcccctccaggtttgcatatagttcggctgctatgcctattaaaggttcactgatgtccatagttaggtttttgaatgaaatattctttagaaaatgctttcatttcttattgcctccccccagcgcccccacccccgcttcaattcactattgctcagaagatttacattaaaatgaagtttatctttgggaaattgagatgttcctgccactgtgattgtctgctgggatatatgatgttgtccctgttacatcgcatctctctactcttaaaaaacatactgatgcatgtcattaaagtactttatttcttcattcagagaataaaaattactgagagggaaaatagctaggatcggtatttctaaaggaaaaaaaaaacctggagaaaggttattactaataaagcaaagagagacagaatgatctctttgaaaagcaatctattttagtatatatgacatagcaacaacttggaattttatggaaatgaaggcgctccctagccctattagataatgtcctcttggggttgcctaggtttgcgtggcagctgcagtttcttctcagactaataaaaagtggaaattaatgagagagtgactttagctggggtaggaaaagcaagctacactattctgtatactgctttggctagcctggggtggtgatgaggtagggatatatatacattgaggagagaggattttttttaaagctctattgaaaaactcttagatacattgctcctccaaagccacataataaaaagctctgagtttttttattaaacaacagagtagacattctgctttagagatttttgtttgtggactcatatacatggtgaccttttccacttccttcttatttttagcatccaattaccgttctctaaatgaatgcttaattcttcagtttggtattacccacagttttattcggctgctgctttaggcaataaaaagtatttgcagttcggtttattaatttgtgtactgtttcctctgctacacacattgtcacttgttcactctttcatatagtattgagcagggtatcttttttcctttggcttatcataacctcagtaaaacacctttacaaggagatcactaagctgctctttatctatagtttttgtctgaaaaaccaagaaggataaaacagacagtatatctcagaatgaaaaacgtgcctcattttggtgaactgtagcctgttcattcctgttgtaagaacatttccttatttccatttaattttgtattcaaaacaatagtgacaaataattctattgtggtgttttagaaggatcactgcacgcctggtttaaaatgcaaaccaggccaggcgcagtggcttactcctgtaatcccaacacttttggaggccaaggtgggtggaccacctgaggtcaggagttcgagaccagcctggccaacatggtgaaaccccacctctactaaaaatacaaaaattagccgggcgtggtggggcccacctgtaatcccacctactcagaaggctgaggcaggagaattgcttgaacacaggaggcggaggttgcagtgagccaagttcgcgccactgcactcccagcctgggtgacagagcaagactctgtttcaaaaaaaaaaaaaaaagcaaaccaggagacaggaaatccagattacgatagctcttgctactttacttatatccttgagttggacatttttgtgggtttggaagtaattaattaaataatttttatgaaatatgctgataagttaatacttaacactacaatgtaattctgtttcgcggcaggtggcccgacgttggggcattcagaaaaacaggccagctatgaactatgataaacttagccgttcactccgctattactatgagaaaggaattatgcaaaaggtgagcagctaatacagcattaaaattcattgaaatgttgcacattaatctgaacatcatactttaaacgccacatatcattgcattgctgaagcgagtttttcactcattttaacaaatgcttagctcttggttttggtattacaagcctttctatgtataaatgcctagacattgtagacaaatgtgtagtgatattgtatacagaataataggctttctggaaggtcctactttgctgcacatggttaaaaaagattgttttagtattaatagcacatctgtcttcagaagtttttattgcacattgtctacaattatataattttggaatgcttttgtttatagcaataaagaatctttagaataaatttgtacttttttcttgttttgattcttaaaacagacatttctttttctcatttgtgaaaacattttcttccttgcctcaaatcttgcctagttttatcatctgatagtttgacatcctaaacca

SEQ ID NO: 15541 - DNA, 1668 bp, Homo sapiens
gaagagcaaccagaggctgaagtaggtatctctcaaaaggattccaatcctgaagattccggggaaggaaagaaagaatctcttgaaagcgaagctgagttggaaggcttacaggatgctcctgcagggccacaggtgtctgaggagtaaaagccagagcaagtgccagtgtggatgatcctcaccctgcaagaagctggaaaactcctaggaatgcattgtcctcaccttgttatacctgcgtggcaccatggcaggattccacatttcatagaatacaggttttcaagcaaacccctgttgaccatgccctaatttcctattgatttctgttctataattgaatggatattcctatggaaaattttttgtttcaaaatacaggaaaaacattcctattacctttctgaggctggctttccagcaattgtttcaaaggaaaatagatccccttaaagaaaaaatacaggctttagggaacaaagggacaagcagaacaggtgtggaagagagattttcaggaagggaaaaatttatagctacagagggtagttagaaaaatcataacttatatgtgaataaaatacatataagcagcatttacggtagtggcattctacttattaagatgcaatgaaatgaagaaaggctttatgttcaaggacctttgccatagttcagctaattgtagttttatatagaaatgatcctgaacactctgaacttgacgtagtcctgcggtgatattctatctgcagtatttgtacctccagaatggcagatccctcagcaggaacaaaggcatattgacggttctctcagcgtatgcattaaaaaaggtacttcctgaaacttttgattcaataatgactaaacatactatgtacacaattactgtaaggctaattcacgtgccatactccacctgaaagcctgagttatcttgctataagcttttcatggagcacttcctttccagaaactgatttgtaactcatttagagaatgtcctggcgtcggtttttagcatatgtggtatttaaacagagctagaatgtgatgtctgaagataatgctgcatttctgggtttcttgtgtggattttaaaataaattgtgcctacaaatataaacaactcatcttgttttataatttgctggggagtggcaaatattagagaagtattagagaacttaaaaaataatagggaacttgacaaatattggagaacagcaaagtaataattattttaatatgtacaattgcagaacaaaatgactagaattctcacctcactttgctgatcaaattctatcttgtggattttgtttgtttgttggtttgtttttgttttgaaatggagtttggctcttgtcgcccacacgggagtgaaatggcactatctcaagctcactgtgacctccgcctctcaggttcaagtgactctcctgcctcagcctcctgagtagctgggattacaggtgcccgccaacacgcccagttaatttttgtacttttttttgtttgttttgagacagagtctcactctgttgtccagactggagtgcggtggtgcaatctcggctcactgcaagctctgcctccccagttcacgccagctaattttttgcatttttagtagagacggggtttcatcatgtgagccag

SEQ ID NO: 15542 - DNA, 1182 bp, Homo sapiens
aatggcactgtctctgctcaccgcaacctccacctcctgggttcaagtgattctcctgcctcagcctcccagtagctgggattacaggcacccaccaccatgcccagctaattttttatatttttaatagagacggagtttcattgttttggcgaggctggtctcgaattcctgacctctggtgatccacctgccttggcctcccaaagtgctgggattacaggcgtgagccaccgcgcccggcctacagtaacttattttaaaagagacatcccttcttattcccctatgccatctttatttgtttgtttatatttgtatattctcgtacattctttggcgatgctctgtggatttttttttcctatcttagataaaatagaattaaagttttgattgttatactctcagtatttatttatttatttgactgttattttgaattgttttattttagatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttggtaaaccatgcattatcgcttcttgtagtatatttatatatttttaattctgttgaagtatttccttataagatagagtctttataagtttatgtttattagagttaataaaaatacaaatggaagcctataattttacctggtttaggatttggaatggtattaatgcagatgtgaaatgattattggttaatagaagcatagaatggaggactttggttgacgttacaacaaagttggccactttgcttctcctaaaagccgcctttctcatatgtccctaatctttcagtgtttttggtggggccataaaaggggtaatttctgcaaaatactataacttagtgtataaatttccaaggtttaattaatgccatttcatccataaataaagcatataagaaatatagtttaaacctggtttttgaaaaatcatttaaattttaagtaagtagaaaaattaaagatagaagattagaaattgttaaagataggtgaaaacaaaataaaagctataccttatagaacagaggcatcaggaaagtagg

SEQ ID NO: 15543 - DNA, 1181 bp, Homo sapiens
aggaacttatttcttaacagttatggaggctaagtcccatgtcaaggggctgcatctggtgagggccttcttgctggtggggactctgcagtgtcccaggaaggctcagagtatcacatggcgagggggctgagtgtgctagctcaggtctcccctcctcttttttaaagccaccaggtcccctcccaacataacccactaatccatgaatggattaatccattcatgagggcagagcccttataatccagtaactctttaaaagcctcatctctcagtattgccacagtagggtccaagtttatctcaattgcttaccctttttttctttttctttgtgaaactgcctgatttcagaagatgtttagctcagtaaatataccagagatttgttgttttgtaaaacagtctttattcttttcttccaaatgtgagatattctaagtgaaatgaagacttttgtcctttatgcttgctgaaatttgaatggcttgttttatagcagtcttttttccctttttcaggaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtgggagaccacgggcagacatcacctcaatacacatgaatgagaggaattacatgggctgtgtagcaaaggctttccttaacaagtctgtcctatgcttattgctgtaaactttgtccacttattcctaccatttaaattaactcagcttcaaagtattgatttagaatcctccatttttgttaacactctaggatggtccagaaattaatagtgatttccacacaactgacttattttaccaggctgctatgattttcaaaatatttcatctgtcaaagagatttgaccatccactatcagtatagcccattatatggtagttttaaaattttgttgcaggttatctaacctgattaagcatttgtctagtgtttggaattaacactggattttttgttcatcactctgtatgaatatgtaacaggctttttatttgaaaaaagtttgaattcctgtcatgggaaaagactagttggatcagtg

SEQ ID NO: 15544 - DNA, 1288 bp, Homo sapiens
gttatattgtttaattttatatatattcaaatttttatataatttatatgtataaatttaatatatataaaatgtattcatttataggtatttgtatatgtatgcatgttgcatttttagacaggcaaaatttacgtgaaagcagaaaagagcaagagtttgctatctgccctcatgtgactattttaccttataatgggtgcctagggtaaaagtatgctggtgcaatggcagggttctgggttggtgactgtagtaacttttgaccttaattagaggaatctgggaggaaatatctcacttctttcttctctcctagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatctgggcttatattgtcagagcttttatttctttcctgtacgtgacttcttacacagatagtattttggtgttttttctctttccatccacaatactgaatggttatatttcttgtcatctattaaaaactattctgctcacacctgtaatcccagcactttgggaggccaacgcgggaagatcatgaggccaggagatcgagaccatcctggctaacacagtgaaaccccatctctactaaaaatacaaaaaattagccgggtgtggtggtgggcacctgtagtctcagctactcgggaggctgaggcaggagaatggcgtgaacccgggaggcggagcttgcagtgagccaagattgtgctactgcaccccagcctgggcgacagagcgagactccgtctcaaataaaaaaaaaacagaaaactgttctgtttctctcatctcatgagtaatacatttcagttatcctcatggcaaaggagaagttaacccccaaatacacgcacattg

SEQ ID NO: 15545 - DNA, 1217 bp, Homo sapiens
gttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagattgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaatttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattgatcgatgaattaagtgaggtggaattcttttctttctgctttagcttctctctgttggacttagagctgggtattgctattttagtgtataatcaagctgtggaaataaatttccagcattaatgtctattggtagtcatcctcaaatcctttcttgaaatgtttcagtggctaatattatctccatggtgagaaaaagtttttctaaaaagagaagccattaatatttatttgggaaaaa

SEQ ID NO: 15546 - DNA, 1116 bp, Homo sapiens
cacttggttagccttaatttttttaaaaaaaaaaaaaacaaaaactttcttgaatatttcagtttgttcattttaagtttgtgctgctggtatttgggaagaaaaatcaatcagttaagtgctaccagaaagtgtaccaatttttataaaaattaagaatgatataaatttcacaatctaaaattttaattttgtgcaatattttcatttaatgcatgtgtatttgagtaattgtaagataaatgaatttttaattttttgagatgtagcttaaactgtcttcttaatccaacaacttacattccgttgttgctgcatccttttatttaaggacttgttttaaaagtctttttgtcactccttggaaaattcttttattagtagtaaattttgcttttaggagcatggctcctgtattacaagggaaaaaatatgaagagcacattttaggattataattgttaaaagataatgtgtgcatatcattgtacagtaagtgtcaactgtgtgcctaactgttctatcaatactttctttctttaacaaagaagaaacaacaatcagaatgtcagttatttttattcaactaaaaggattaaaaaatttatttggtttgtgttctgtccattagaaaatactaataaagtattaacaaacatttttgttgagttcatttaatagtaatgtatttttgttacttttaagatgcttgctcagtagtcttatttttagtatctgtttgtattttcttttcttttagatatcaaccaattcaagttccaggttgatagatgagtgcttgagtgattactgacttaaatggactgaatttaactttttcttttatggggcaaataatttacaccacagtgttaaagaaactttatacttcctcatcgtatcaaattataaagtattttcccacagatgaaaagatttataattagtaatccattttatttgatctcattttaaattcatattttggctaatattttagattttgccattctaaaagtagattggtcataatatttgcatctttcttggagctgtatcaacagacttctaaggcctcagatgtgataacttctagcccatcagggattggcatat

SEQ ID NO: 15547 - DNA, 1138 bp, Homo sapiens
attaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaactataatatttttaaaaatatgcttttatttatatttcacataatgtaaagttctacaaaataaagctagtaggcaagacccctcagtgtatacctttaaacccataaattaattttatatcaataaaataaaatactttctctagttttggagcttctgtatttcctatagttttctgactgtccattttatccatctt

SEQ ID NO: 15548 - DNA, 1741 bp, Homo sapiens
aatgttttcagtgatatgaaaaggttaagtatgccagtagtttacaaaacagaaaatacttaactaggagtaggaggctttatatgctaaaaatgataaaactgactgtaaattaatttggggaaagccagtattgttaaaataccattttatacaaaataaaaagctgctctcactgtcagctctcatattcttccaggttttgcactctacataaaattatttctacaatgtcaagactagccaaaggactttataatacaatattatattactaaagaatgagttaagtttgagattttgatgatttgattttgtgtgtgtttaataggcttcaccttattacatgctattttattttgcttttttaaaaactcaggacattaactaattttaggttttcctttatcatggctttctacagtatttctattgtttaacataaaatagtttgccaaagaagtttctgaagtcttcacagctcttaaaagccaggccagtactgactgtgtggtggtaaatgctattcattattttcttttctttcttccaagtgcatgtgtgtccttgtcttcttaagtctgagaggttgctggaaaggactgttttcttgtacttgttcatttgtgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtccaaattgagatgtgctgtcagtataaaatacataccagattttaaagatgtaccaaaaaatgtaaactatctcaatttttatattggtgaaatcaatatgtcttggtatagtggcttaaataaaacaattttagcctttctcagtttatttttctgcaaaaagattaaaaattgtacatgaagctcatgttaactttcttttggtcagtgctattttaaaggaagtatgagttgaaaaaaaattgaaataaactatatcatattactaggacttaatatagtggcatacccaggaaatgcttagtaagtgttcccttcacattttaaaatttgagtatacaatcatgtttga

SEQ ID NO: 15549 - DNA, 1136 bp, Homo sapiens
ttgcataatgagaagagaagcgggacaggagagaactagtgggttcgttttcagatgcgttgcattacaattatcaggcctgcttaggattccgtgtactgcataaaatatactccataaatattttgattttttattgtacagtccaagcctgtaaaattctaccaaacccacctcactactggaaatgatcaaagtgagaacccccatttttaagctacctacttaatccaataagcctctgtgcgaaaacacacatttgcctgcccttaaaagagcagtcggttggctttcctgcgtgctcaatgcatttccgaggctctaagctcccgttctcgaagcgcgaaaacgcggttccccctgctggtcagggctgcgtaatgcagcgaaaagaggggaaattcctaggggcgtggtcgttggtggatggcgtaaaacgagcgccggggacatgggattgtgcttgcgtcaacggcgcgcgccgtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagctccttcgctattctgagaggtaccgatctctttgcctgttccttcttttgtgcacgggaagtaaagcaggtggatgtgctgacgacgcagcagaaaggggcaaatggcaaaggtcgcattgccccccagagcttagccccctggatttctagagtcgcgatccgtccctcaaggccagtaccgctctggtaaagatctatacagggtccctttcatagatagagaagaaaacttaaagatgaagttcaggtgtgggcggagggagtggagattcttgctccagaaccctggtgtaggggtaggaaaagaccagggatctggagacctagtaggcccagttctgtttggcattcaacgtttcatttatccccttacggatgatgctttctcatttgac

SEQ ID NO: 15550 - DNA, 1121 bp, Homo sapiens
gaccccgtaggcaaaatcacaaccttgctattaaaaaaaattttgttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaa

SEQ ID NO: 15551 - DNA, 1171 bp, Homo sapiens
ttcataaatttgtctctacccttgacctttgtccagaggcctagttctttatttctaactgcttgctaaacgtctgtggcaggcaggctgtcttagtacgaaacatcagcgtttaaaatcagaagcatctgtctcaccaaagccgctccttcatacacattctcccctgtttaatggtatttccattctcacagtcacccatagttatctttgattgtcagatcccatggattctacttttgcattgtctcttgcatttggccacatcttagggtgctgacccagttatacttatgttgtcatggagcctattaacttgtcagttaagagcagggtacttgcctcactcattttcacttgccgcttggtgtccagaacagtgccttacgcaaagggagcaagccctcactatttgttgaatgaatgtcaattaagtgttttaatactttacctgcatttcatgaactatttgtcattgaatatattttctgttattaattctcttaatacttttaatcttaaccaatcaagcacaagaataaaatttcatacccagaacctcaactatggtacttctgttccttctcaggatgagaaattagttaagcatgcaggggtcaggaaacattaatttacctttccttcttgagagccagatgtaattcgtaggattattacatttttatggcaattttagataacatatttccctttgtacattaatttttctgctttttctcttctttatttttaataggtcttcaaaatggaaaactatcacaatgacatagatgctattgatagtacatcaatatgattcagctcttcccctgcctggcagagtgtggctgctgtgtgcacagccatgtaatacatattagttacacaggcattagagaagcccttcccatccatatgtatgtgcatggcctgtggaagttaataatgccatatatcacatgcacatagaatgtaaaacgtacttcagaatgacagcaagctcatataaaatgagtattggcgcatgattaaaggaaaccagggaaagatttttgtcctttcagagaacagaattatttgtttgttctgtgtgtctcagcatcccagaccctcattctgcctttttgtttttttgttttttgtttttcgttttttggggggtttttttggt

SEQ ID NO: 15552 - DNA, 1155 bp, Homo sapiens
ggcgtcgctgcggccgcggctgagggacctgcccgcgctgctgcggagcgggctcacgctgcggaggaagcggagcgccgctgggggccgggtgagtggcccggccctgtccgagtgggcacgggcggcgcgcacgtggagcccgcgcccaccccccgggccgctgaggggggcgtctggaagttggggaggtggcggaagggacgcccttctgccggactcggctgaagaggggcccgggacggcgggttttgaggtgccaccccctgagcgacggcttcccccgcccccacacctcccccccaccaggctgcacctgacttaaccccagggcccccagattcaggctgcgggaccgggcatcggctgaagacgagctgtttgcctcttctcggaggggaagctgcaggtgtccagcgtccaacagccagccagccctgtcccaaccgcaagcttcaggccccacgagcggcatccctgtttgcaggacgcatgcgacgtgtgtgcttgttttggaggtgctgttgcaagctctgggcatcgagactggttttggtggtctccaccgccgaggggcagacccaggagtcggaagctcttgggtgagcttccagttcctgggttccggtgtctccagcacttaatactcctggacaccctcttgagcaggagggtgcacgcccccaagaaccttcaatattgacttcctgatggtgtgttcagatacgatttcctggtgaaggagtgtccctcattgagttctaagtgcatctaatgacctgagcaggtcaggcatgttttgtatttttaagagaagcaggaaggtctgctgattgtctcctgggatctttaagaagccacctaggaggccccgccagggcctcaggacacagagctgacttactcagatttccctgctcaccagggtttggcggcacctttggtgggttctactcatcttttaaaaatttattattaagtggtctttaatgagaagctgcatcaatgtggtttttctttcccgtttggctgtaatttttaaaatgcagtcttgtctgacttaaaacaagaccttgctgggagacttctagctctttcagagatgggtttgtgtaaacttgagagtgagggataaccacttgttttcatgcgccc

SEQ ID NO: 15553 - DNA, 2351 bp, Homo sapiens
aaatgaatcatagagctaagtataaaatgtaaaactataaacttttaaaggaaaatataggagaaaattattacatccctaaattaggcaaaaattcttatattaataacaccaaaacaatactttcaaggaaaaaaattggtaaattagaattcattaaaaattaagaatttgctttgcaaatgacatcgtcaaaataatgcaaagaaaagccacaaactaggaaaaaaccatctgtgaattacatatatgacaaaagacttgtatccagaatataaaaagatctcaaaaatgcaacaataaaaacacaaggaaatttttaaaagaatcaaaattttgacctttttcgcaacgggtttgccgccagaacacaggtgtcgtgaaaactacccctaaaagccaaaatgggaaaggaaaagactcatatcaacattgtcgtcattggacacgtagattcaggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagggacttcatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaatcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcatccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgtcgctggtgacagcaaaaatgacccaccaatggaagcagcgggcttcactgctcaggtgattatcctgaaccatccaggccaaataagcaccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaatggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaactggaccaaaaatttgtcacagaattttgagacccattaaaaaagttaaatgagaaaaaaaaaaaaagaatcaaaattttgaacagacacttcaactaaaatacatatgtatggcaagtaagcacatgaaaagacagtcaacatcaatagacatcagggaaatacaaactgaaaccactacctgccaattaggaaggctaaagtttaaacacaatatgacagtacaatgtattagtgaggattcaggccactgaaatatttgaacaacagtttggtagtttcttataagaaacttaaatacacactgacgatctgatccag

SEQ ID NO: 15554 - DNA, 2479 bp, Homo sapiens
ttatctggtatcttgttaaaaatgcagaatttcatgccactctaggtctactaaatcagaatttgcattcttaacaaggttcccaagtgatttttatgagaagaaagtatcagagtgcaaacaaattactcgtctaatatgtagaattcccagtggtctcacagccctagatcaaatgtgtcagacactagatcattataatcttcattggttttgacagctaattaattagtttaataatattgacatatggcttcttaagtatttgaattctagattgctaatgatccttatttttgcagtaaaaaagtaacactttatatttttcttgttaactataaatggaatcagagctgtaaatgcctgaaattttaagtgtgaaaaggggtgccacccttttatatactgcacaacaaatttgcatttgtatattctttttaaaaaatctctgaagacttgctcagtgaaatggttctgattttttgcttcaaatgatttgcactaattgattttctggagagcggagttacgttaacaacaaaattcttttatagttcctttgatactatttcaaataaggattacacattgaaagtttttatagaaattatgaaaattggataatcttaactatggtaaccattactattatccatactactttctccccactgaactttcaaatttgaaaattggggtagcttttgtaggtcactttcttataaagatgctgatggtcacagatctcctaagtatccagaataatatttttatcatgagaaggattccacacaaaattggggtcttgcaccccatatttcagaggatctgaacagaaattgtggcttcattgcacattttaaatctctatagattcttgaaatcacccaacctctcacatttgaaaacccaacggcctggagtattctggtggcactggagccagcactagctttttggaatccaagtggggagagaaacaaaaatagacttttcaagggactgtcccagactacccagggcaaatgtcttcccttcccttcctgaagccacaggaaagcaccctggagtcctttgtataccactatggaaatttttaaggcaagctctcaagacttgaagagttggaattctcggcatttaaatgatgcctgaagtttgttttgaaaaagcaatatttcattgctcttttcaattgtgaagcaactgctcagcaaatattactcatttttttaaaaagttgaattaaagggaaatatatttttaaaaccaaaatagatcaaaatgatcccagttttaagggattttgcctattttggaagaataaaactaaaatgttaaaactgttgaattacagagaacagatgtactctgagacataattttaaacaaatatttaaaataaggcaggttaacatttgcgtttaggcacaataaatctgtattaaagggaagcacatcaaggaaatatatacatgttgaataatgtaactgaaaaatattttttaaaaaccacttaaaaagaaaaataatttgatgggtactttaagcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtcttctatactttgtaacttgtgcatatctaaagaaactaacaacgaacattttgggagatgtttttgtgtttttttatagtagagttttagagtacatttgtcttaataggaagtttttaccataaacccaagattttatttcacgtattgttgctttctcttatatggaacttattgtgtacctcttacctttatttctaatcatttagtgatactaatcttttcatagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatgtagtactttatacaacaagtgttgcctcttgttttattgaaataaaaactgaaaaaaatattttttccagatcagtttactcatttaaaaaattattataaaaatttgcagaagttttgatatgaaggaagagaataaaggaggaagacttaggtaagttgagccattgagagcttttgggggtaagtgataagacaatgacctcattcctggctttgtgctttacatgtcatagggctgaggagtatgacaggtccactcgtattcatccaaagatgaagatgagctctatgggccatgcaccagtggcggattatttgtcatatcagaagcacaggca

SEQ ID NO: 15555 - DNA, 1241 bp, Homo sapiens
ggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaaatgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttacagatgtctttttgtcattctttaacaatgaatttcccctgtgcatagttat

SEQ ID NO: 15556 - DNA, 1234 bp, Homo sapiens
ttgtttaggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactgttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgat

SEQ ID NO: 15557 - DNA, 1104 bp, Homo sapiens
agatttactctaatattcaccaatcatagttgcataaaatctagactgtctccagagtgtacaacattattttaacatacggcttgcattactaatagagtttatatgttaattcgtatggtattctagatacttaagttttgtacctttcaaaatagaaaagaaatataaggtcattttcttcacatatttcatatttaaatgattacttcgcttagcaaatataacttgttacatgagtaagatcaaggattattaagacactgtatctgtatctcagccatcctgaaaatttgttacatatgttttttaagtggaaggatgtacagtttaactaccggtgttgatgaataataatggattatcatggtttaaggttttaacttaaaattcctttctattcaggtctttttcaaaaaaatgttttagactatttaaatttagtttgtaaatttgtgtgtaagaaagtatgtattttaatatattttctttcacttctataggaaatagttgacaaacagggacataccaaagtattgagttttacgattccatctttatccaaaccatctgtataccatgaagtaagtgacattttatcacagtaagtttattgaccctaagctttgatattgccacaagttataatctagttatttaggaaaaaaattgatcaatttattagtacctgcaaaagtataaacacccacaaagtatttactatttccaaattgagataagaaatcaaaataaatgaacatcaaactaaaatgtgctaataagagatctattgaaagtattctttttgaaatatttttccctcttcctgatggatggctacttgtgtgtgttggccggcgggcaggggggtggtgggtgggcaattgtgtatttccatggtagaatttgtgaaattaaactaatttttatttctcatttgtggtttgttttaaaattagttattaaatcttcgagcagaaaatttggtaggcagcctaaatatgtttaagatatatgatgttcgtggtagctattttagtggtatatatatattctatatatcaccttttcagcagaatagctttttttttctttattcaaatg

SEQ ID NO: 15558 - DNA, 1238 bp, Homo sapiens
ttaacagcaacttctggacattcagtaccaggaactgttttaggtgctgtggagagaagagttaaaaatgaaacaaaaattattgccttcatgagcctcacattagtggacagagtccaaaaaaaaagtgacaacgtaatgcgctactgcgacacaaagcaaagcaaggtgggcaagcaacactagttctttattcccgcacgccctaatccccaagtagctcttccgggtcactgcagtcttcacgggctccagactccgcccatggtccgtccttcaggccttgactccgcccacgcatcgacgtagaatttcccggccgggctccatgaagtaccacccacccgcgacgccgacgcaaggctgctgctatggggccgggcggccgtgtggcgcggctgctcgccccactaatgtggcgcagggcggtttcctcggtggcggggtccgcggttggagccgagcccgggcttcggctgctggccgtgcagcggcttcccgtaggagcagcgttctgccgggcttgccagaccccaaactttgtccgcggcctgcacagcgagcctgggctggaggagcgggcggaggggacggtcaacgagggacgcccagaatcggacgcggcaggtacgggcgtggagaagaacgaaggcgaccctctccgggcagtctggagtcaggtcccagccaaggtggctctgggttcccctctatgtgcatttctcttggagtcacaaaactcctgcacatccagagctggaagggacttcaaaggttgttggcgccaaccttcccgtttcacagtgaagaaattgagggcaagagatgaactgcagaatcccagcctcccggacggccatctcccacccttggcatcacagtctcaccgtcctcacttccttttaccctcttcctaggatcctgggaaatgggtttgtggggactgttggggcttgaggattctgaggagccagggtctgggtgcgaaggggtgcgtaggaagcgccagtaggagatgggtccaagttaatatcctctagttattgctgacgtttttagaaacttaagaatggtaaacagatcacatctaagaatgtagagtatgagagggagaggccttagtgggcttagctactaggtcctttggagtcggctttagaacttgggcgagcttttaaatttacagcctgtaatactccaagctgaagatcagaatatctaaatctttacgggaaaaa

SEQ ID NO: 15559 - DNA, 1254 bp, Homo sapiens
gaaaactggaaggttcaaaataataattactcaaaaatgtagctctttcagtgactgatcttaggccacagtaattctcctaggcctcagtttcttcatctctcaactgaaggttgtggaccagatactgcctaagagcccttccagctcacaattctgtgacccgttatgactgagattcaatttaatatgctccaggatatcacctcctacccattttgtggtgctgtttttctttgcacagcatttctgtgattgtggtgtattgctccttttaagtattagtagaaagtcatttgtcactggtgtctggttctacttgcatatggttaatagcgaaggatgtatagtggctctgcgtaatctgagcaccctgaccataaaagttgagcggtgctatgatactactgcccaggttcaccttccaggaggcctttaccctgctatctgtaaaaacactttggatctaaacaccctcatggaggaacagtcagctgccggcatctctgggtgcatacacgtctatctgcttggccatcctgatacaaacaactatttgtgcatttcagatcatactggtcccaagtttgacatcgatatgatggtttcacttctgaggcaagaaaatgcaagagacatttgtgtgatccaggttcctccagaaatgagatatacagattactttgtgattgttagtggaacttctacccgacacttacatgccatggccttctacgttgtgaaaatggtaggatgctttcttttctcttttggaccattaactgagtggaatagtgacagtgcatcaggccaaggagcaacacttagagggtaaacccatcatacaaagttacagaagaagcccaaattttcagaatttgcatgaattcattttatgttctttgatagtgaaacatatgggagcaaatatccagccctattgagttaggatatatcaaaatcttttctcttgtgaccgcaaggaagattttttttttttttctaattgagatggagttttgctcttgttgcccaggctggagtgcaatggcgcgatctctgctcaccgcaacctccgcctcccgggtttaagtgattctcctgcctcatcctcctgagtagctgggattacaggcatgcgccaccaggcccagataattttgtatttttagtagagacgggtttctccatgttggtcaggctggtctcaaactcctgacctcaggggatccgcctgcctcagcctcctaaagt

SEQ ID NO: 15560 - DNA, 2646 bp, Homo sapiens
ttcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgcagcttgttgtgtagtatgttttatttttggttttcaattgaatgggaatgttctgaattttttttcaaactctacgcagatttctgttataccatgtccagccatggtacttaatgtgaaccttgataatactcttgcatatgaactaagaactagagcgttcagagtttttcctaacaaacactttgtttactttcttgtgttactggagtattctggaagggttacagaagtcctcctagaagaatattatcacctcaaagtataaaaataagaccagtgggctatgttttatattattttttaaaatttttgccattccattaaacaaacagggttaagatttacatttaagctaaattaaattaataaaaatctgagcagagaagtcaagcacaggagccagtgcta

SEQ ID NO: 15561 - DNA, 1183 bp, Homo sapiens
tgatcacaccactgcactccagcctaggccacacagtaagaccctgcctcagacaaacaaaggcatgtggtgtgcagtatccttgaaacttagggtacagagattcctagagtgtgttgcatacacaggaagcccaaggagccctgatgcaagtgggccaaggaccatactttgagcaccactggtgtagtgaacacaggcaatggagacagacccagctctccctctagctctgttagctgtgtgatcatggtccagataactcaatttctccagccttccatttccgcatttgtgaagtggaggtaatactacttcatcaggacgtggtgaggattagctgagagacagcacgtggaggtctccattagggcccggcacagaataagcatatagtatatgcaggagggaggcctaaattgtgaacccacaggaattgctgcctctccctaatttccttcacgaaggctttaattctgcatttcagccagtcacatgcaaatgttaggctggttggcccaagatgcctatcagtgatacctgaaagtatcataacttgttgttgggtctgttacagattgctccagcggaagcaccagatgctaaagtgaggatggtgattatcactggaccaccagaggctcagttcaaggtatgtgctctagagtatgtgctatgtccacaggtaacaaatgcacaggtagtccataacctggcgtctcccttaaatatgtctaaatctcagaaagagtcaatggaaattcttatctaagagctgagtagaatcacactcaaaattatatttcgaaattaaccaaaagtctttaattttaagagttctgtactggttgctggatttacctgtctctcaaaggttaattttgcttaatggtttgtaatcctatgctaaggtgagaccttaaaatttacaaacctgccaggttaatatgccttggaaacttgttttcagatgttttccctcctgtccctgagattgcctagacttgaattaaaatgccccctttttccttacccttggattatctctgttagaccctgcccatagactctacaaatctctctaatccctgggatcttagagataggaatggcaggagctcttgtagcatttgttctggtatgaaccattgcacgtttagtgggatttgaggtctttggggct

SEQ ID NO: 15562 - DNA, 1259 bp, Homo sapiens
ctaaagaaactggtaaaaactaagtttagacacaggaattctggcttgtgtttttggaatatttccatgctttctccttgcttggtgacccagaaaatgcaattgcacgagaatgccaattatgcctagaattggttaatacagactaggaacatacttatgaaaggttatgtacttagggtatttggtttcctcaaaaactatacatctttccagtcattttttaattcactgttcaattgtgaaaatggttcaactttaagcggttgagaagtaagctttatttaaaatatggacttgattgaactatatgtatccagtaatcgttagttgagaaaatgggagggcaaatattttcttctctcttgcagctttacagtttcggatttacgtcttttggggcttactcatttcccatcatgttttaccacccacttttacatattaccaggctccacagtttgtttttaattgccgtctgtggctgaattattagctgtcttcctccaattttcattctttttctttcccttctttttcattctgcagattgcaggaattgacgctgtataatccagaacgcactattacagttaaaggcaatgttgagacatgtgccaaagctgaggaggagatcatgaagaaaatcagggagtcttatgaaaatgatattgcttctatgaatgttagttttgttatgaagggcatgtctttattttaacaaatagttaaaacaatgtttttaactgcattaatattgaattcttttgtggcattatcactagaagtagttctagttgatttttagcacctcagcaagtaccctgggatagtagggaagatactggctttgacattaagctttgctgtctctgtgactttagcaaattattcagtctttgagccttagcttccttctgtctgaagtaaggctagtgtctacctacaaaggttaatatagtacctctcttacaatgttaatttgagagagtttaatatagaagaaatgttacatgaactggatttgaatcacagctgaaccatttatgagctgcagctctcttctcttatatgatttactcagtctctctgaggctcagtttactcatctgtaaaatgggactactgcctaccttgcattcttattaggattacaatagatataatgcatataaaagttaatgttaagattacaggtttaaaacttggttagccatataaaccttggagatacaagaatttcaattgataaaacaatc

SEQ ID NO: 15563 - DNA, 2911 bp, Homo sapiens
caatgaacctagatagcgccactgcacttcagcctgggcaacagagtgagactccgtcccaaaaaagaaaaaaattagccgggcgtggtggcgcgcgcgggagcctgaggtgggaggatcgtctgagcccgggagtttgaggctgtggtgagcagtgatcgcttcactgcacttcagcttgggtgacagagcgagaccctgactcaaaaaataaacaaacataaaaaaacgcttccaatgttttgttcccttacatcagaatccacttggacaatatttaaaggggctaaggtcatataaggctcatctggcgactgaaaagtcttcaaagaggttgacgcgtccgaggtgagtctgaagtttggaggacagcacgggaccgcgattccaaggcgcccaggttgagagcgcaggccgcccgccaacctccaccctcgctccaggcccagccgacacaaagcctcgcgggaggtggagcctcgtgacgtcacagagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggagccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggttagtcaacgaccgcaccgacccttaagcgttcttaagacgagagctgtgaggggaaactacgcaaggagcccttttcccttaatgtcccttcgactttcctttcacttcgaaatgaatgtggaaatgctgtcacgccttatttttctaattcctcgatgttgggttttttctcttctttatatctcaacttttaatgctcttcttcctatgacctttcatctaaaaactgaccactcctttacaggtttttacggtaaaaaaaaaaaaatctgtctttctttaatcttacatagctgaacgaattcattggctcagtatttttaagataactagtcagtatatactgttctgtaacttaaaagatgacctgaaaattaacaggccctctcccatttctcttctcactctatcccccaccgaagagggctcagaaaaaagtttttattaatatatttggggtcggagaaatacaaacatcacaaagaatacgatatccccagcttaaatgtactggaacgtttgtcagtgagtttcatttccaaagtttaccctacatagggaattgtagaagtgagttagtagaagtgagttcgtgtgaaaccctggaaagaaaacaaaagccccatgcaacacgttccgggctgttgtgtagatgtttattctagtcactaggggaagcacataaaaacacctgaggtgtgtgtgctgaagggcgaattttgtccttttggggagttcatgatataaacatctagaaccaaaaagtcaaatcagaaggtcagtttaggctttagttctctttgaggaaagatttaaagcaatagactataatagttacccggtagactaaaaaatttgcctttaattcttttgattggaatttttttttacaaagtttggagcatggaaacaaatgaaaattgaacctgcttattttttaggatggtgtattgatggccccaacagaactttctaaaatcatgcgataaacatatatgatagtagttgtaaaatgcttcttgttttgaaaatgttgagtaattatcgatagaaattttgctgtccattcatacattccttcaattaactttcattgttaaaaaattgggggattgatgtttggtttggtttgtggggagtgaagaggactactggagggaccttgtttgcttgctttttttctttttttaatttatcatcaagtctaggaaaggagtaagttgccgacaattgtcacttttccctcctaagaaagtaacatgttaagattcccacctaccagcctgggtgacagtgagactcccgtctcaaaaaaaaaaaaaaagattcccacccacttttaagctaaagtatatgtaggcattaaagatttatttaatagaaataaagggccctcttacggccctttgtggtcataggaaatatttttttcacaagtggtacccaagtgtattttagtgtaaatcaactagtgcttgtaggctcacctgttgtatctttttatttttcgtcttttagtttttataggatgagataattgtctttatttg

SEQ ID NO: 15564 - DNA, 1187 bp, Homo sapiens
aagctagtgtacctggagggaggaatttatgttggttaatgagtaacatagttctctcatcccattacttatttatgatcaatttatttttaattaagcttttaaaattattaatgctacatgacatgcaaagttaaaatcagcatggaagaatgaatgtaccatgaaagttaaaggtttctatccctactcttacttcatagagttaatcatggttagtagtttcagatttagttatattagtaaagtggttctcaattcatgactggcatttttggcagtactatactttgcaatgcaggattgtcctgacctgaacactactcagtgtttagtgtcccttaatatttggttttctaccacagttactgagacaatcaaaaatggcctagtacatttccaaatgctcactggggagaggtggtatgctaattttaaaaaacatacatcttagaaagcatatgtttatgttttcaatttcacacagtaagtattgactctagtataaaagaatatttaagtgcgcacagacttcttgagggaggcccagagaaagtccacttgggaggaactgtgcttacttctaaagtcttagatgataagatttttcaatcttacctgctttctttcctgatagtcttactttcttgtgttttcagctacctgtctttttgttactgtttgatgatttttgaattgtgtgctcttgcttcgctgggttttattggaggaaattctgtgcagcccagttagaggacacattctttccaaggtttgccaaggcttttctttggcacctgtggaagccactgacccaagaccacttcgtagtttctctgcttggggtgttctgaactaggcaggtaggtatatttggaaccctgaatccttgagagtaggctgtgattactaattctcaggtgatatttttttctgctaatatggagtccaatctgagacaggccaacttccttattgtcttccttggccaacaggcatgtttttattagactactcttacaaagtaggggttagtcctataaggtctcagcttcatgtgggaaggtctaagttgcatttttcatcttgaacaggccagggcctaaatggcagcttctgaactcctggttactgaaatcctaaacaccccagggcagtcataacttcagtacctacttactagtttg

SEQ ID NO: 15565 - DNA, 1251 bp, Homo sapiens
gggaaataattgtcagctattttgtatacatacacacaaaatatatacattatataatatgtatattatgtattatataatatatataaaatgttttgtatattttttacatatctgttaaaaaatgtactttgtttttttgtttgtttgttttgagatggagtctctctctgtcacccatgctggagtacagtggcgcgatctcagcccgctgcaacctctgcctcctgggttcatgcgactctcgtgcctcagcctcccaagtaattgagattacagttgggtgccaccatgtccggctaatttttgtatttttagtacagatggggtttcaccatgttggccagggtggtctcgagctcctgacctcaagtgatccacccaccttggcctcccaaagtgctgagattacaagcatgagccactgcacctagccaagaagtgtactttttgtttaatgattaccgaaagaagttctcctttagaagcattgacttatacaaattcccacattcacctcagttaatatcttcctttaggattcttggataatagaaattcttcctaaaacatactcagagatgcagctcattattaaattaaggtaaccacattctgtattgttgctagcttttcatgtaaacattattcacactttaaaggattaggtgtttaaatattgatggtcatctttgtctggtgttaggtgccagacacctggctgctgaatttgttttttccctcaccaaagttgtcatttggaacgccagctgggaggactttgaaggaaaagaaaatatatgacaataggcagtattgacacattgtttaaaatctttttcacaataaaacaaaacacccaagttgtcatattgttaaagttggaaatctataggtttttctttttttttttttttttctttttttgattctagatttcatggccagaacacaaattcacgtttcttgtcctaggacagggaattggtgacaaaatggattatactattttaataacagtggaaactttcaaactacatgtgtttacaccaaattcttggcttctcaaagcaacatgaattaaagcacagtatcaaggtgatgccctatgacaatgtttcaacacacacttgaaattttaagagaaatttcagttcttcactcaggaaatgtgctgtattctctaatgtactttcatgctgcagcatggagcctctttaaacagctttgggataattatagcagcacaag

SEQ ID NO: 15566 - DNA, 1141 bp, Homo sapiens
aaaggaattatttctattataaatggtattcatgattgactacttaattaatgcacattagatttctcctaatataaaatgaaatgatgcagtttagttcatttcagtctagatgcccgtactaacaagaatacagttagataagttcattgtatctcaatgaagaatcattgaacttgaaacccaagtcccaaatgaatctgcaggaatgagcagtgctctgcgggggcaaacagccccagaggtcccagggttcttcctaggtaatgagagtatagctgtgatcaaggaaatgtgaacttctcttttgggaagatctgcgataattagctttatggaagcgaaaatggtttagagtggtgttgagcaattgttaagagttgaaatagacacacacatgcatgtgcttttgggaaacatgatgtgccaacgtattaatgtgcctgagggctccttgtggataggtcagtgtccacatttcagcactcagggcatgactgtacacaacctaagactatatatatattttttcattttcaaatgtacaaatacccatagaggtgatgtgcctggataagtcatttaaccatagcttagtgaaataaatgtgatggccctaaaaagtagaattttcactttcattacagccatgcctttattatgcagtctccatttctgtgtgatatttggtaatatcacatgtcaaatacatcaggactttgtttattttggctaactctaactatacaattgctgaacatagctttctgaaatagaaattataagagaaacccagtatgcctacagcattagtagcctaaatcctagattctagaatccaataaatttatagtagttcttaagaagtttcctttaaagcaacaaatagattattaaggcaaatttagataataacccaagttagcaataaaaccatgtgacattatagattatgtccagatactaactgctttgaccataatatcccaatgacaataaaaaatgatccttggtttaaaaattattaaatggtacttatttttatgtataacaagtgtcatgatcccagtgactggagttgattttcaaggtggatagccatagagttaggtaaaattattttgaattggcaaactaaaga

SEQ ID NO: 15567 - DNA, 1130 bp, Homo sapiens
gtaaataggtcccgaaatggcgactcatgccctctccctaattcagtcaccaggatcttgcctccttaactcttcttggggaaggaaggacaaaaaggaaaataaaaaatcactgagaagtatattttttagctattctatgtaacaaacctcttaaaatgttgtcactttactcaatggccatttgttctctctcccaagcctaagggtggggcaagtggttttgtgggtggtcctggcttggtagatctcagctgggcctgctcacgcttctgcagtcacctgctgggctggttggggcctcactgatctagaatagtctcacctgggatgactcagcgacttccccttggcaggattctaggggagagtggaaccaatggctgggctggaacctgcatgccagcacctcccccacatgctgttggtcaagccagattcaagagatggggaaacagactccgcctctggatgccgcaaagtcccacggcaaagggcaggaatatagaggtgagtggagaattggaatcatcatgatgcatcggtaatgagaggagaaggcagtgggagaagtaatttggggggaaaagaggaacaggctcaatctaaaagaatgggattgctcctcacttcggttgcccctgccctctcttcagccctctcctcaagtataggaaggtttaataccatttgtctagaaaaaaattgatctgatctggtctgatgactctggtgagcctcctacttctctctgtggagtgccattggcttctctgaggtattgggcacacatctgagtaggcagctttgagaccagcaagtcagcagggctcctaaggccaggagcgatgtctcagcctccagcagcacccaggccactttgtcagaggaatcggagggcaaggaggagaatcttagcatcaccctataagatcagggccctgcttacctgtcctatgccatcatttgccatttctcctcatacacacccactccctggcatactgagctaccttcatttcctgaaattgtggtgaaaagagcctcatgtctttgcacactcactccttgtgctgagaatgcctctccccacccagacaactcccttcccagttcagggtgagggtcac

SEQ ID NO: 15568 - DNA, 4019 bp, Homo sapiens
ttgaagctattttagaggaatttcattaaatatttcacatggaaacttggaaagctggaaatggatgtgaggagacagttcaaaatggtattgaaaatattaagtgattacttaaaggcttattttataataggtggcaattttggaggtagccccggttatggaggaggaagaggaggatatggtggtggaggacctggatatggcaaccagggtgggggctacggaggtggttatgacaactatggaggaggtaataaattcacctgcaacctttatgtgggaatttggaattaatgtctttgtaacacttgatcttttgtttccatgtttgtcactagatgcccataaaatttgtggataagtgtttgcttttatttgtttttatgggagctttgtcctaagtccttggtttaatgtttgtattgttctgagtattccaattttttaataggaaattatggaagtggaaattacaatgattttggaaattataaccagcaaccttctaactacggtccaatgaagagtggaaactttggtggtagcaggaacatggggggaccatatggtggaggtaatttataaaaattgaggttattcagatttttgtgattaaaggattagccttttgtgacttaaagggaagataacatactaagtagtttgtactgtgggcagtgctccatgtacggtcttagtgaaaataaagaaattttgcataaatctccacagaagtactcagcaagcagttatgacatcaaattgggattagggatgttggaggtgggggtgttcagtagtttaatttctggtggggactcataaacagctaaatacagttgcaacccacattgcaagtggtatacattggaatgagggtctttgaagttaaatccttaaaccatgattcaaaccattgcttagcttatttttgaggtttttagctaggagtaaactagctttgtcttgggcttgatgtacttttaaaaaaatcccttactcagtccaaatgaggatgagagggtgaaaggaccctttatttaaaagaatagggtcagccacgaaataaaaatgtctatgaacccgagtaatttatctcctgagtaattctgctaactggctgcaaaggattaggatctgcttgtttaaaagactggatggatataaaatagaatcaactgtagtgttaggctgatcatgggaaatcaaagtaagtttgttttctcttgctgttccaacaattataggaaactatggtccaggaggcagtggaggaagtgggggttatggtgggaggagccgatactgagcttcttcctatttgccatgggtaagtagcttttgagttttacaattattattatcttgggagacatagctgcaggagtaaaagctttttaggatcatgttatctttccttaaaatctggttagatggataatttcataacctattttttttttactctttacttctgttgaaacaggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgggtagtataattaaggtccgttgcaaagctgttgttatatttgtataagataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttccctttttttccttcttttcccaccccctccccctccatgtgaagatttgggtgcttaacatatcatttttttccctgccggaattttagcattgatatgaaccatggacaagtatattctgctgccacaaagactgtaaagtgcttcatttcaacagctgaggcaagccaagtgatcattaataaagcttttcttggttccttcagtggtgttggtagtaaaatggtaggtaaaagttaggctgcaagttcaataaatcatgagatttcccatcgttacacccttgtgtattcacatttcttggatcaaacattttgagtgaactaggggtttttattaaagacatttgttgtatttatggttgtaactgtacatgcttatcaggatgagactgaaagaaggtagggcaaaaatggttgaatctattttcagatagtagttcatacttgagtgaagtgtcttgtctgcattatgaagcctggtatgtatccagtactaaataggtgggttaaatgtggtaattctagttcagtgtcttaccctgaagagaaagttgtaggttggctgttgaaattcattccttagatatgatcagtttgattgcccggctttattgcctttacaggaatgtgatactcagggcttactctatacaccaatgagtcttctttgatcctaagaccaccactgaagttgtttaggttcttttggacaaacatgataaacttcttcagatactttttttttcctttggcaggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatactttttgtatccaaatacttggtgtaatgtttacacataaaatgtgtgaatcttgttctataaatatttggttgtctaaaagatcaccatcccctaaatttttaaaagcagtttcacaaagctatgcatattttaatattaacaggtaaatgagaagagcattgtggacattattggctgtccccaataaaatgctgttcattatgcactgtatattcagcgtttgagtactcctaaagtttctggctttacttttacgtttagcaatactggtggcattttgaaaatcatggattttaaaggttaaccggctggagtggtccagattaag

SEQ ID NO: 15569 - DNA, 1429 bp, Homo sapiens
gttcctttggagaggaaaaaggtactctgccagcaggtcacctcatatttaagaatttaatttcctgcatacaaagaggaaaatgtaaataaaaattgaaatggtattttcctttgcagagagaaaaggaacagttccgtaagctctttattggtggcttaagctttgaaaccacagaagaaagtttgaggaactactacgaacaatggggaaagcttacagactgtgtggtatgtaaattactgaattgttactggatattagtcttttagctgtatgttaagtgaatcatggaggaaataactatcagcatagtaaaaaattctattatgacttcacttataagctataatgagattaaatgctaaagtttaccctttggtttgaaaggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggtaagcaaacaatgactgtcttgtgcattaacatgaagaacgctgccctgctgaaaatcagaaactatttctgaatttagttttaactcaagattttttctcttattaaaggtgtgttgggtttctggaccattttcttaagctagcttatttttcaaaagctaggtccctaaaagctattttatatctggtagttttaaggtggatacaagcgaagtatggtactacggttgggtgctttgaattatgcttgtgtttttttctgtttggatgacttttaccccaccactattttaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtatgtaagtgtctaaccacaaatgtactgtttttttccagtgtattcaattttgtgtatgttaacatctgtaactttattgaaaggtaaacttttgaagctgcttaatattgttgatttaatttaaaaggagtctgaatttttcattccagtgcagaaataccataccatcaatggtcataatgcagaagtaagaaaggctttgtctagacaagaaatgcaggaagttcagagttctaggagtggaagaggaggtaattttaattctgtttcttctttatttttgttcatatataagggcttgcttctaactggggcatttattgtaggcaactttggctttggggattcacgtggtggcggtggaaatttcggaccaggaccagga

SEQ ID NO: 15570 - DNA, 1247 bp, Homo sapiens
ctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaa

SEQ ID NO: 15571 - DNA, 1224 bp, Homo sapiens
taatttttaaaataagaatttttaaaataaaaactttatggaatttactttggaaatgaatagattatttagagaaagttcttttgatagtaaccagctgttttcccaaacttcctccttttcagtaaaataccactttttatggcctttctgaagagttgaattgacaaaatgttgagtaaaaatacatttttccttggctaaaagtgtaatttttttaagcaggaaaaatcaagtttcagctgaatcaaaaattaaaatgcagctttccctttctcctgcagaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaagaaataattatagtttttatttacccatttgatttgtgtgaagaattcatcactattttatacgtaacatatagtctactatagcatagtatgctactattgctacttctggtgtgatttgtaatgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagataactttattgttattatttattttcacacatttaattcctattaagtacagccgcaagaaagaaaaaatgatgaagttgcaaatggcagtgtgctgtcacctgcaacagaagtgcgtaccagaagtatgactcatgcaaagcattttaccgtacaaatatcctggtgcgatgatgggcctggcaacattttctactgtacttttgtttaaatttaatgaaacaaaaaattcctaagaaataccaccctaccactaacaaaatggtataaagaatctcccagccaggccaacatggtgaaaccctgtctctactaaaaattagccaagtgtggtaatgttcacctgcagtcccagctacttgggaggccaaggcacgagaattgcttgaacaaggtaggcagaggttgcagtgagccaagatcgcgccactgcac

SEQ ID NO: 15572 - DNA, 1181 bp, Homo sapiens
cagaatgaaaattcattcccctgaaatatttaggtgtctatattctatattttgatctattaagggattagtatttttccatgtttattgtgttatcagagtgcattagaaagattagtgattcatcttcacagcacatttttaatcaagcagttatttcaaccagcacattcgttttgttcatattcactatagaatgatatcttgtaaataaagacattcagcacactgtgaaaatgtatttgtgcacctgctttttaaatatttctactaaaaatgaaaaaaaaaaacccttagacctgtagatagtgatatcgtaatattaattgttaataaaatagtcactgccattaaaatctgcagaaaatactctttactttcctatgctaaatgtgcactgcacagaaagaaaaggagcaggtttatcttatataaaccaaggaccattctttattattattcagtacttcttttgctaccaaatttttaagaaaagggagaaatccctcataactaaaatcctaaaaaatgataagtgcttcaaggagattaaagtgtcaggtattacaaaagggagagaaaagaaaggaggaagagatagtatgaattcccaggctccctgtggaaaatgaaaaccagttgttttgtagcagcaatgcctaggctgtcgtattttaaaatctgctgttgggtctgcatgtgtctgagagggcaggttttgatatttgttgaaatgacaggactacgaaaggccttaaaccttgaccttgacgaaaaaaaagacaatttgtgaccttgacttttgacagctcatgaattggccttagctggattagtagatcaagggcgccacctcgcgttgacaagcctccttgtaattcttcaaccaagggaatcaagagctcttacctccttgactttagagattcagtactcaattatttggctccagctggagcaaatttgaatatatgtaaattatacatgtccctgtatatatgtaaatatatataatatgtgtacacatgtatacatttgcatattagtgcttgtgtgtgcttgtatatatatttgtagaatctgtacagatatcatatcattaattgctaatgacgcaagatattgtaatttaaggtgatttctagaattgaggtacaaaatgtactttacaagatgaagcc

SEQ ID NO: 15573 - DNA, 1214 bp, Homo sapiens
tatgaaagcgcttatttaaaaatgttaacttaccatagtatttataagtatcttattttttcagattacatttttccttctttcaaaccaaaacataaggaaccacagttccaaagagcctttaccaccagtctcagcgtgttctctcctcctgtttgatttaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgttcattcttactacgtattttttgacttaagaatgacatctttagatgcatttcagagccaatgatgatatttgctttagataattattatattattataaatatagccatattattttgaattcaaataaatttctatactggtaatactttcttggtgtttttgtttcttccccatcatttggtgaactaatgttctgacaaactgatgttcacactaatggggaaaggatgggaataaagagaaaggaggggaggtcaaaagg

SEQ ID NO: 15574 - DNA, 1205 bp, Homo sapiens
ttttcttaagctcgtttacagctcctggctcatctcttgcatttattctcataaaaactaaaggaataaacatacatataaatgcattcacacagactcccatgatgcatcgtttatctgtcagtatttctttctgaaatatatcatttgtgggtaaagaatgtagaatttaaattatcatattgttttaaggttcttatgtgacatataaatgtagtaatgtccaaagactagaaaacccatgagtgtgataaaccaacaatatttttatgcaattgtatattattttttcttaataataggataacatagaaggttttctccaaatgcaaaatggtcctggctcaaaaatattcttatttaaccagtagtgtttagtactctataattcaaaattggattcttcactctcgtatcaacctgcttagattttagaagacatataataaatggagagagaagatggagcatccccatacataaataagtcacgcacgacgtgtacattttgacacttaacacttcttttctttgacctttgacaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggtatggtaaatgtagacacccaagagagaaggaaaaacgtttcacggtccaataacaccttccttctctttctcttaataaagcatatgtctcaggtaagaggcaaaattactagaatattcactctcactgaaaatgagtaaaaacctaacttagatgaaaatccttatcttgttcatttttattcctggccttttggttgagaagaatgggccagaccatgtgtgtgtgtgtatgtgtgtgcgtgtgtgtgtgtgtgcgcacttgggtttatttatatgagccggtaaaatttcgttcaccattaatttatgttaatttaccaacttcttaaatgagaacagtgagaattttctcattgttaataatacactggcagtgcatatatgcatcacgaagagaggattttcccattgataatagatttccaaatacatcttcctgctttaagattttaatatatggatttatatataaaaactagttaagtcattggaaaagca

SEQ ID NO: 15575 - DNA, 1206 bp, Homo sapiens
ccttcttatatatttacccttcgccccggatctccttctttctctttcttgtctgtttaaatcctgccttggcctcctaaaggatgatttcaggttccacttcctctctgttcctgccttcagtggtcttgttgctctgaactcctatctcttatagcctctaccttacaattcaccacttgtttttgttgccttttcatacagcatattactcccatttccaattagattgtaagttccatcccttaaagagcagttgtgccctatagtgctgagcccgtagtagctatgtggaaaataaattttcacataggcaaatttattacctagtggaggagacccgcaagtctgctctgggatagcatgtgaggttcagagggagccatgctgcatcaggttctcttccgcactcgagaaaatcaacagttgaatgttatttcttttagaaagcagcccctggaattgggcaaggaaaaacgtcctgtgagttttaccttgaaaatacagatatttaatatgtactcaatttattttcaggcggcaaagatctgcaacaacatgctgttagctattagtatgattggaactgctgaagctatgaatcttggaatcaggtttgttgaatagtacgtttttatactaacatttttataggctttcctatttgattttctgatgttaaaaaaatgatattcatgagagataaatgagttgatccaagaacattttgaaagtacttcattattgaactttaatagactttgcttattggacaagcaataggacccaggagagcatgaatactctttgccatagccataaaatgtattgcctgtgcatttgaagttgtgcatttgaagctatattatcctttttatgtgggacccccatttcttctattatgttgaaatacaagaaacacttttctgtaaaatttaaacatactttggcaatgttgggacaaatttgtataagacatggttttagtgtgtagtgaattcaagtggtatgctaccatgtgactagtttatgtaccttttaaaaatatagtcccccaaatctgcactaaaagtgttcttggtggttcattctcaggctaaaaactggatagcattcataaagatgcaattcatatgcataactctttcattttattttgcctgtggtttagttactttgcattcgtatgtatctttctattaaagt

SEQ ID NO: 15576 - DNA, 1203 bp, Homo sapiens
gcttgatattttattttgtcattaaagttacaattataaaataatatgccatcccaacacaaatggctagattttaattgcttatgtttattcttcattgtggaaataacacggatatatgaaatttgcagtatggcttgttaaagacaaataaattactttttaaagatccagctactttacagacaaaaatttaagtcctatctaatacccttttaaagttaataggtgttttaaattgcttacatcttagcttcatgtttattattatggttagtgtgtagttcatctgaaatcagaatttataccatgtagtatattaggttttattaggttttttttggatcttttgaaagagtttgggtttacttttgaagtacaattggtctcaaaaagaatgagatttttaaacgtgttctaattaataatgtttttaatactaaactaaaatcctccttgatatatggcagcttttcagcagattctaattctgtaggtagttgcatgaaatttttactcagagttgtaaactacaaatatttttatttatttacttagaaaagtgaagaagggctcattattaatagattccagcactattgatcctgcagtttcaaaagaattggccaaagaagttgagaaaatgggagcagttttcatggatgcccctgtttctggtggtaagtggtagctaaaatatatgcaaacctatttatgtttgtcaaaagtagcaattatggttttgttgtaccatatggttttgtagtagttatttttagacttgttacaggattctcattaaaaataaagccaaactgatacgttatttagtactctcaagtctaaataactaacattgttagtcttaaattcagataaaaaagtgtcataactttgaagtgttgtgaatttttggtccatttactgtggataggaatacatcagtttttagaaaattttttttggaactattgaaaaaaaaatcagcttaaataatcctgtaactgttaaagaaattgaacaagtgggaaaaaaagaaaaacaattgtttcacaagggaagcattggctcagatcattttacagatgaatattaccaaaatttcaaggagcagatcatctaaattttatacgaacttttccagagaacaggaaaagaggaaatacttcccaattcattctgtaagacctttataactctgat

SEQ ID NO: 15577 - DNA, 1126 bp, Homo sapiens
ataatgtgcctttgcaattttttttaaaggtagtatcttccccagcagatgttgctgaaaaagctgacagaattattacaatgctgcccaccagtatcaatgcaatagaagcttattccggagcaaatgggattctaaagtatgtatttctcacctgtggatattttcttgttatgatagttcatgaatttcacatgttagaactattaggaaattacaattgtgtttgttaaacctttctatactgtttttatttcataaagtgaatagtgtggtggttttctcattgtaaaaggcttattttttcactgaagtcaagtatgtgacaatgtgtataaaattttttggttccgtttctttcctttaactcttgcgttaaacttaccctttcactagtaacatgtttaagagacttttaaagcttacatttgaaactgcaactgttaataatataattttcttacagcttatagaaattcaggaaaagggttttatgaaaaatatagccaaacattggaaagaacaccatcgtttaacattttattatacgaaaaaaagttatgtcctgtgggttagtacgtttgtagtaagaactttgggaagttggaattaaaggttagcagtagctctttaacccatttatgtcagaggttgcaaatttttttgtgaaaaatcagaccttggcaatgaccttgagtagtaggatgtactgcttgagcagtaggatgtaaataactcccacaaacttagcataaatggaacactaggcataaatgggttaagtaaaatacagtttaggtcagtttcctaatcagtgcctgtcttccctggctctgagaaaccttttggttaattgctgcttattgccaaacccttgcggttatgttaggatgatagtgattgaattcccagcttagttttgtcatgtcactgtttctattcctaacttattttgttgttgaatttcagcaaagagctagagcaaactggtagacactgtagtcacaagaagggctaaaagaaagggtgtaatttcaggaaactgtaatatgtgaaatttgaagtttctggtaattgaattgtgttggaaaactaaccaacttggaaggaagcaaaagacacttgg

SEQ ID NO: 15578 - DNA, 1172 bp, Homo sapiens
ataatatggaatacttcacattataagtaaattacatattaggtgttttataaatgataacattatttagtttattgttaaaaatggtaaaagaatgttatacaggtacaaaacaggaaaaatgcttaaaattttgtgaatgtgccccagaaaactaaataattagaagttagtctgcctgcacattgttgataactttaaatgtggttaggtccattagtttaaaatttgccttttaaaagttagtgggttttttttttaataaatattattatttatttttgagatgggatctcactgtgttgcctaggctgttctaaaactcctgggctcgagcagtcctcctacctcagcctcccaagtagctgggattataggtgtgcaccactgcacctggttcctgaaagtttcttttattaaaaaaaaaaaatctaacaattgacttgctaatattaaatgaatgtttacaataaaaaatgttatttgcccctattgaaaataatgtattgaaatcagtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtaagaccttttctttagatttgttttagattttgagaatgaaaaatgaatatacattcaaataagtgacagcttcttagaagtatacccaatggagttgtaaacctaattcagtgttaattttatatatatgtaatcattcatccaacatccagatttgcagtaaaggagagttctcgttagacattcaggggtatctattctttggcaggtgacttggaacattttgcacatttggtcagagggccttgttttagctctgtatcagttttctgagatagtaactttactgattgtgctgttaaagtagttagtttggtggaaataacctcctgtgttattaaaagcacatatgtctttaaaacaagagtaggcttagagatataaagcttagtttgagttgaagctcagatacatgctttcttactgggggcaagttacatcacttctgctgatttcctcattcttaaaatgtgaacgatgacaacctatgcc

SEQ ID NO: 15579 - DNA, 1100 bp, Homo sapiens
ggagaaagaggaaaaggaaaaagtattccaatatagtttctaagctttagtcacagtgtagtctgagattgaattctgttaacagaagtacgaaagtaggcttgggacattaaccatcaatttaaaaggcagatttggaacttgggaaagagaaagtggtacacgagttaatatttgtgatttattcccgggggcgtgatatttgaaggtttggaagaaggtgagttttcagagagaatattgagagaagaggccaaagaagaaactttggagaatactcatatttggactgggaagaaaaaaaacacaaaaaaagggcatgggatgatgaaaatattcatgcaatttcacataaaccaaaggaatagttttaagaataaggcaagttggtcaataaatgacaagtaattcagagaagtcaaagaattagctgaggaaaatacgtggatttagtaataggaattattttcgtaaaacagtataaaccagatctcaaagttgcaaggagggagtaggtaaatgaaaaaaaataaagaaatttctttctttattcagcttcaattggcagagaaagacaaagaaataagtggtctgatttcacatttggaaaacctctccagggagaaggtattgagcaatgtagttaaacaaatgtgtatcacatgaaactgaataataatagagctttatgaagagacacattttgaagttcatgtgacagtacaatgttcaaatttaggaaaacagtgaaatttctaaaaattacgtgaaatgtttatctggttttcttttgtaataggaaacatttttgaagttgtttaatgacttacagcaaaacctcacattcacatagagcaatacatttgtaatgtaaaagatactatagtgcagcatttctgaaagtgtggtctgtggtccttttggtggttcccaatcccctttcaggggcctgcaaagaaacaattttcataataatactacaacattatttgattttctccctgctgtgacatttgcactgtgtgaaagcagtgtggaaaactgcttgtgtattattatgaattaaggcagtggcaccaaactgcattagtagttattgt

SEQ ID NO: 15580 - DNA, 1177 bp, Homo sapiens
agaaatgtttctggagtaaagacttttaaggtaggttgtttagtatgaatatcagctaactagataaatggaaccttgtcatatatggacaagttgttgttctacatttattagaaacatgtaattctttcatttttctctttaagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaag

SEQ ID NO: 15581 - DNA, 1197 bp, Homo sapiens
tactaactccattatgtaaggcatggtaaccagtttgataatgaaggtattattttggttttgaacatatgtgagttgatgtgttgaaaacttcaatcacattacaatcttgaaaaaaaaatctcagtgccagcccctcctccccccaggttgataccaccgcaatacaattcaacaatatgcaacatgccctcaattttattttgttttgggggaaatgtgctgaagaacctagagctttttttgtttagcaccttatatcaaagtaatgaaaatgggtatgatgattacatgtgcaaatgtacaaaatcattaactctacaaagatacatcattccaaaattacagaaaaaatttaaagcatgcatttaattctttttctttaaagggttgctgaatgcttcccctgaaaaaaggtggctgttttcaaaatcagcaactgctggtgaggatttcttggcacagttatgaccagcatgttattgctgcatcttcctgataatctcagccgacaccgggggatggaaattgattgtgtggtgccgcaggccctgagctgtcttgtaactcttcccacagcgacacttgaatggtttgcggacacgaatctgtgttctgtgaccattcttagcgtgatactttatgccattcacattctgtggagaagacaaaaatatttattacatggattcacaggatacctgtcaaacttcggaaacctcaatttgggtctggattgcagttcctggatggcagctgtttagagtgtagtcttttgcaaggactccagttgggacccttcaaggacattctggtgtgtcggtcatgggctgtacggatggtcacacacacagctgactcaaaatttcagatgtgcctcaattactctgaaaatgaaagtactgatttcttccaattttatataaaatatatatttaggacttacagactgtataaagaaaatcctctgaatcttttccactctaaagaaagttaacagtgaacaatcctacacaaatatcctcagcatgaccaacaaaatatctttctaaagaaaaacatcagggcatatcccaaaagtttaacatatagaaatttttgatttggaaactcaatttacagcttgcttctagataactgtgttaacagttccctaccatgccttaaccagagtttttgtcagttttctgctctgca

SEQ ID NO: 15582 - DNA, 1110 bp, Homo sapiens
attatgaccatatttatgatctgatgtcactgtggtcaagataaccagtgtcaaattaagtttcaaatgaatcaaggacttagcaagcccatttctagaattccaccctaaaaatagtgcacagcctttttttttaatagcaaaaaatgggattcacctaaatatccattaatatggggagtgcttaagtaaagtatattcactataggaaacactatgcagccattaaaaagaataatactgtctgttttatgttgttaagtaaagtaagtcacttatagaacagtttatagagcatgatgtggtttttggggaaaaccaaccaattacaatatacatttataggtagacagagaaggtttggaagaaagtatactaaattgtttatggtaaaaatcaggaaaagtggagatggagggaggtaaagtttttttactctctgtatgtgtgtattttaaaattattttctcatatttacttaatacatactttttatattctagggatagtttagctcactatcaggtaaatgccctgttgtaagtaaataaatgagcttctgtggtccaggaggagtggggagaagcttctggtattaagggatgctggggcatagtaatgatgagaggggttatcactgagggagaactttacattcttcattttggaaaatgctgccaacagccctgtggggtagatgctgttacacttactttatacccgaggatgcacaggtttggagagatgtgttgatttgccgggtcataaatttgcagtgagtgtagtaaggctttgaacccaggtcagcttggctctagcgacatgcccataacctcttcccttttgcctgcttggtttctgaggacagttctttaaaagtggatttgatttcctgggacgtgtgtcctttacctcttcatttctttcaagaaaatgaggacacaattcaggagtagttgttattgtcgttaatggttgacattttttataaatgcttagactagtcattaagaagtctcattctgtgctcatgggattcacagtggattctccagtgagtggaagtctttgtcctaaaatgaggcagtgtataataatgtcagttaattt

SEQ ID NO: 15583 - DNA, 1180 bp, Homo sapiens
tgagaccctgtatctacaaaaaaaaacaaaaaccaaaaaccaaaaaacaaaacaaaaaacccacaaaaattagccggtagtcccagctactagggagactgacatgggaggattgcttgagcctgggaggtagaggttgcagtgagccaaaaccgtgccactgcactctagcctgggcaacagagcaagaacctatctcaataaataaataaataagaaatcacgtatataaagcacacagcaaagcataggataaacacgcaataagcctttatctgagagtgaaatgtattttaaagtttgatactgaaagttatgtgtgtgtctctttgcatttgtctcatcccttcccttcccttcactgttgactacaagagacattggaaatcattgaaaaatccattccctagttaatgttccccggcttgccttttatactatctgtcggatccaatccatcatgtatgtaatcatattttacattggctgctctatgaataagaaatgagtggagggtgttttgttttctacctcttccctatcatgagggactaggtacaggatgcagatttcagctctacagctgaagggcgcagatagtaaatcattttacatgcctaggatggaagacaagctccttggggattctgtgatggtggtggaagaggggccttcttcctgatcagcactttgggtgccagcctgctctggtcaatgggaaagaatggaaaccttagaattcaaccatatctgcctgggcctggggtgggatgaactaaaaaaccagagcctcaaggtggcttgggtaaagtgcctactggaatttacactttctcacaagcatcagagagatgttaggacacaaaaaactcttttgtgctgcagaagattttgcaatctttgggtgccaggaaaggtttcagtttccttagctgtaaaatagagatcaaagcccccttgcttgcttcactggatcatgtggagaacaaaatataagcatgaaagtgaaaacacctcgcacatctagggagagcttgcagtattgctatgaaaagtggtagcataaattaacagcatgaagcatttatgtatcatttctccaacaacccacttttcagcaatgatttcctcacatttgcattttggtgctgttttgttgtttagatacgaattaatgcta

SEQ ID NO: 15584 - DNA, 1147 bp, Homo sapiens
tgacaattcttgcctgtttttccaagccattctgtttcctcaaacccaatcctccccttggactctggctttttagaagacaaaagccagaaatgctcccagggtccttctgcatctcatcctgccgctcacctccctaaagcaagtacacgggtcagctatacctgctcaaaagggcaatgaagaaggaaaacgtcagtaactctgactaaaggcagaaacgtgctttcttggagtgagacagagaatgcacagaagaacatgattataagcagggagtgggtaaagagaacagggaaggagggaggcttactggccctcttatgcttttgagctgggtctcaaaggctgggcgggatttcatttgacagagcacaccgaacagaaaggcaggagcagaaagaaaatagaagtggtgtttgcatgaaggtaaatcatctcatctgactagacacatttgagcagtgagaaaataaaccaaaaaaagtaggctggagtcagtttgtggcaggccttcagagcccagggtgttttgacatcaacttaagtagttggcagccattgagtcagagagtgagttgattagactgctgtgttagaaaatgaaatagcaacgctgtctaggatggattaatggctgggactgttgaaagactagagcagggagacctttcagtaggttgtgcaatcatctagaaactggaaggaaaaggaggaacgagctgcaaaagatactgctgaagaagagtaaacagactttggccactgggtgaatataaaagaaggacaagagaaagctgttgatggtaagaatgtggatgttctcacagaccagggaaaacgaagggaagctgctggtttgcgggaggatgaacaggctggtcatgttgaatctgagtttccatcaggacagctggagctatgggcagggagctcagaagagaaggcaggactttccctgtgataggaagagaacagggtcatgatgctgtgggagtatgtggtggtaaaagaggaaaattgagggatatggtgttggttgctttgatcttctcagtaaggtaggagacaaggccattcgctgagataagggaagccacactgtgtcatcttggagtttgagagtggacatggtttgaaacagctg

SEQ ID NO: 15585 - DNA, 1194 bp, Homo sapiens
ttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctgg

SEQ ID NO: 15586 - DNA, 1061 bp, Homo sapiens
aaggaaagctgctcagcatggccattttgcatttgtataggtagtgactagatgtacacaacttaatttgctgggaatgaggggcttaatattatctgagatcattgagaacccagatcagacagaatagcttgaataagttacattttccaattaccctttttccacatctgtagaaagagggtaatattttttaataggtattttccccactggagcatattacgtttgcctaagatgtataaaagtttgtttaagatgtgtaaaagtttgcttaaggaactgaggatccttaaataaaaatattagaaattagaaattgaacctaatactaaacagtaaattcagcttaacctgaaccttggcatagtcagagcttcctcctacatctaaagtatttgctctctgttttagttaaagtcataatttgcgctgatgtgtaatcactttccaagaagagggcaatgagaaaagatatttaaagctttctctccatagccctccaagacttctgggacaactaaatttactttcaccattactgtgagaggaggtgagaaaactctagtattttgttggcagagtaatcactttgttctcatcgctcaaagcatttttaggattatttttctagcgtaacctttagagagaactggaagaaaaaggaaattggtctactaggtattgtagacacaaataagtaacattaggctaaccccttatgagacatttccacacaatttcatcgtgcctgtacttttctctatggtaaaagccagtgtttacactttgtagggatcagggtgtatttgttgaattaaacaaaatattttcaatgatggcaagtctcttgacttttgaaagcaagtcagattccttatagctaatgctggtgaaaaatgttaaattggagagatcccttttgggagtgaaaccaaattgtaactatgaggagaagatggtcttctcattggctcttgatgtagctctgaagggagttccagaagaggagctctcacagaatgttgagcctgtgggcccaagacattgacttcgaaggg

SEQ ID NO: 15587 - DNA, 2178 bp, Homo sapiens
tactttccaaatatattaacaaaaagttgatgcttttaactttatattttcagaaaagtgtttttaattaaaaatatgtgatagggaccaaataagtaaagtacatttttctccactaaatttgaagtgagggaaagaggagccaaagtaagagatttttttttaaggaaacttaatctgattgtgaaaatcatacatatggagaaacatcagatcaggcaatagagtcagagggtcatgagcaatagacgatgatgcgaggcatttggggagcttcctggaggaaaattaagtttttttcctagcaaactaccatgtcctacaagaacttggttatataatggtgcgtctctgaatcactgattaaaaccagttgcttctgattttagtcacaggttttacaagtattcagctctccctcatgtttcatttctttttttaagataatctatcaaccttttttaaattttaaaatttttagatgtagagtttataagtaaaatatatttttagccattgttctgttagctgagctgatgtgtttggtcttagagggcctgacttcagatactctttgtgatcttgtaagggctctacacaaacttcattatgtatggtaaatttgtattcttatggattgtatatagaatgctttcgttagaagtacattctacttctgtatgtccctttgtaatccgcagttgcttactcaggggtttcatagtcatttcataaaaaataattcactagctgtctaatggtattttaagactgtttatctgtatcacaacgtcattaggagttctttcaacaattccataaatatactgtttactagaccttccctgtaaatgttcccaattcccatcctgtctcagacagtcaatagtcctgtgtacagtgactatttgcatgatttctcattgcactgctgcattcaggcactccagggcatgattaaacagtcattaacagtgcctctctggtacagttgatgcatgcattgatctttcttctctgctgtttttatatagcctttaattaaaaggaaaaaaataccactactctgcaatgcaaaagtcttcaaaattctttgtttcctgtattaatcacttctgttccagagtgaacaaatgttttcagctaagctatgtgagaatgtaagaataatatcctgcttgttctaaatagttcatatatttaaagtgtggtcagtatttcctccctgtaccttacaaacagaaaccaccctgggatggttgataccccttacaaagtcgatcttacccacacagactcctgtgtatgcgtgtctgtttataggtgtatatggagtcagtgttgataggaaggatgctctagaagtacttctgttgtttcctagaaggctatgagccagttccatggcatgtttaatgtataattcccatgtatcatgagaatttcactagaatgtcattaaacagcccaactacctcatgtgaaattggctgtggacaatctgtgtcagatgagaaatgtgttcagataaatttaatctggttaatagacttaacaaattaatgtctacataaagaagaaacatgatagaccagatgccaaaggctaaaatgtacatagatttccttggattaatttttaagtcactgtttaattccatgcctagtattcttatgaatgtttgtggtttcatagatttatgcactttgaatatctgtcacgtgcagtgttaatgttacctgttcttgtctctcagcattttgaatgagcatcataatcagagtagaaggcaagttaaactataaaagtgtcaagtggcttgttaacttcttaatttaatggacctttacttagaatataatatgttggagcctcttgggaccaaccgatgagcgacagtttcatgtttagatttgtattgtttctctgtccaagtccttattctctatcttgtggggaggggtgacaggggagggttttactttttttgcaaaaatgtttgaaaatatctgtcagattttatattcgttagttataataaacttatttttaaagtattaagttcttaaaggtttttgtgtggttttctgcctaattgaatatgtcaataaaaagtctcgtttatggaacacacatgacttgctgggcatcagtctaagccgtttacaaatataagaa

SEQ ID NO: 15588 - DNA, 1212 bp, Homo sapiens
tggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatat

SEQ ID NO: 15589 - DNA, 1277 bp, Homo sapiens
tgtctgttatacaaattgttgtatactgatgttttataggttcatcaaggattgctttggaggatttatcagaggattaattagacatttagctatttagcctggtaaaacgcttgttgaacaaggttaaaacgtttcctgctaacttgtttcagaatgtattctgctatattgtgttattggaacatttgctgtcctgctattttaattttatttcagatatttttgtcctttattaagtcgctgtcatttttaagtgtatagattttacttaggtgtttcctctttggcctcttgagcaacttttcctttatagcagaaagtttacctattagaaaaccgtgataatttagagagaagttaggtcatctgcaactgatcctgcctgtggttatagaagttagttagcttgcattttctgggaaatttttcataacagataattctgtatttgccagactcagaacagatcctaccagtaaatgagataagttcatcttttcagtttagactccaggccttttgctgcgcttatgttttatatagtctaaagttctttgcttatggaagttgatttatttgcccccccttttttttactggcatgtttaaaacaattttacctttgaacggaatttgaaaaaaaatgcagtgcattcctgcaagcagtgcttataattgtggttataatcaccagtaattagaatttcctaatctgcctttaattgtgccattcttgcctctagaactgaggccaactgtatagttcatttccgtatttatttggatatttattaagtgttgactgtaggtctagctgggtgcttggacagagtgatcagatgtaacacgcagaataatatgcaatttctgccccacaggtatcaaatttgggagataagatctacacagaagtagtattacacatgatatgtcaaatgagtgttatcagtaaaaggaattcagtaggacagagaaggacattttgcttttgagttctctaaaagatttcattgagatggtgagacttgatctgggcttgaagggatgggagtaaatttttagtaaagtaggatgaaaatattggcttaatcaagagcaaaggcatggagatgtaatgggtatgttctattggaggaaaataattaaatggcaacaccaaatttgtattaggctcatagtgggaaatagtgggaaagccttgtacagggaatggtggcatggggttgcttgcatgcattcagtaatgcaaaagagggccaacagccaggatgctgt

SEQ ID NO: 15590 - DNA, 1171 bp, Homo sapiens
aagaattgctgcatccagttctgaaatcctcagatttccaaaagtctctttcagaatctatacaaaagttttgatattcctttgcattttcttgagttaagcaactttttaaaagtcccacatttggggtgatttcttgaacttacccaattttattattttataatttttaaaattataattttattttcatgtctttttagccacattacactgtaaaattctttgaactatcttggtcacactaaaggaaaataaattcatggtacaaataactagcttattgataaagttatagagcaaaatctgcccaatttgggtgattctgtactgtttttgcttactgtaatgcttcaataaaatagaaatgaaaacgtgagacaatggaagtaaaggtaaacattattcagtcatttatgaatagtatttcaaatacacgtgctgagttttatgtatttctggcgaaaagatatgccaagtaaggtggaatcacaactttttatcagttagcattcacgtaattcttttttcaatttgatggataattttattgtcctgaattcattttctctttcttcagaggatgtactgagtaaagatgctggggaatgtgcaatatgccttgaagaattgcagcagggagatactatagcacgactgccttgtctatgcatatatcataaagggtaagttcaccaagttggtattagagtaaaagattgttctcacagtttcagacattgtaattagggctgaaaaggaatcttcgttgaaaccaccccctccctgtctcacacacacttcttaaaacttaatgatcttttttctctatttgaactaagacttgaacccacatctgtttgtatccaaaaggctactatttttaaagcatttgctatgacccagctgttgtccatagcttcttgaataaattatctcatgtaagccttgtaaccattgcattttacaattgagaaaataagctaagggacagtatggaattgccccaaggttacaaggctagtaaatggcagagttgagattccagtagatttggaatctgcttgactccaaaacctgtctgctttctcatatggtcttcttgcttttagagtgatacaggaaaaatttggggttaaaaaaaaaaaagtttaaggtaaccacaaaaaga

SEQ ID NO: 15591 - DNA, 2739 bp, Homo sapiens
ataaattcttgtataccttttaatagtcctagattaaaggtatatgggtttgaggaggattcagtgttgttaaaacattttgtaaggcactgtgtagccataaagctcaacgtttctgatatccttcagcataagaatttaataatcaacccaaaatagagagacatgaatatttgtggtcttgattagttagaaaattgctgtacttattttggggtttttagttatttgggagaaatattttaaatctccgtgtgtgtgcattctttacttgcgtgtagtccttattgtgaaagggggatgactttgttatgtattttttgtgactaaactttaattgatccttctgtttcttaatctgttcttctccagatcactgattttatgagttttcagaatagtaagtaagggtatgaagacttacagtaactaaagcaatgttcatggggaaatctatttttacacaggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggtaatactgataaacattttgtattcagacgccaaagttaactgatttaaaagttgatttactttttattaagttctccagagctgcacaactagttatgttttgatttgttttgttttttaatttggggtctctttgttttccccaacataatgttcataatgtttctgcattcatctgttcttaaattgaaaaacatataatttacttcttataaattgaagtcttaaatgtgaaaccaagaaatgtaatcaagcagtaaaaacatctgaatgtagaccatgatctcaagttcttccattttctcccccacgagtggaaaatagacttctacataggaaagctaaaatatgttaatatttttaaattaaaggtttaatatcagaatgcagtccaaagagcaaatcatattacataattacattttaattaaatatagaatattctactgaattgcaatttattaaatattcttatcctcttaaataaaactgctcaacagttaatcagcagtgaatcatcttgcagctatgcaatttaaaaaaaatacagattaccaatttcaagtgctgccagctaaaataactgttttaacgggtatcttttgtttgttcttttcacttaattattttattgtgctttgcatctccaggcagttctctcacatttgggtaaaatgtttagcaggctgtaaacttaagaaaagggtaaaataaaattttctggagaggaacttggaatttgagggagattttatatacctttaaaaactgtaatttaattgggatgccaggtttatagcaatttgcaactttaattttccagataatctggaggttagcatttgataaatgattttttaaagtagatatgaagattttgttaatttataatttattcatgtgttattactgtaattgaaaatgttatagacacttttaaattcagtttgtgtagaaagaaatgtgttaaacaaaattatgttaataaatattcccacataatacatctgaatggttaaaaatactggaagagttgtcagggctacaatagtgaatgtccttttttttaatatcaaaaatatcgataagtaggttttgtgttttcaacgtagggaaaatgttatcagtgaataggtggtgtactttacttggtataatttaaagttgcacagtaagtactgtttccttattttaatctttctttactcataatgtatttaagaatttgctgttttatttaacgctgctactcttaatcttctctaaatttttccccctactttcttgcttctgtttcacattttttaaaagggcaagtacaggagcaactgctgctacccagaaaaatgtgtgtattataaataattaaagagtttttaattgctttctgtatgattccagctcagataacattttccctgaagttatgctgtgaaatgccttttgttatgctgcaattgctaaaggaatccaaaacctccattgtgacagctgaaggcacagtttaataggtgcttttttactagttatgaaaaatattcgtcccttaaggaaacgattctttttctgtttttttctgttaccatgaagtcttaatttgatttcattttatttcacatttttgattttgtaagctttcataccctcctgctcaaccccctcaagtaaaacctcttagaatgtgaataattggttcattttctattgctggtatactcttgtgatgagaattattttgttgtcttccattcttaaaggaagagatttattacagctgtggggattaactgtattctcctggaagttgattttctgataggttaatgcaaaagtcattgcaaaaactgctattacttttgcgccaatttaatagttcacttgtttactttttaacctatattggcttaaattcactttttagcccctctttgtcataaggttctgtgctgcatttgctacaatagaagctcctatggttttaaagaaagttcagtgttttgtcagtgtca

SEQ ID NO: 15592 - DNA, 1703 bp, Homo sapiens
tagattgtgttttagagcaatgttgtgattgaaatataaataatggtataactttttttgtgttagcaaaaacaacattaaaaaggttatgttacataatatgtaggttttggtttcttagtgcaagacttatatttctcttaaatgttgtataattatttcagttttcactcactagctactttactaaaatgtagccccaaaatgacgggccagcctcagcgtatctgccatatgtatttcaaagattacagtcagaatgagttaatgaaaatggcaggttccttttcaaagtttatttgactcacagccatattgctaagtttgggtatagtgaagttaacaacaatcacttaaattaatatcttacagcaagatatactgatactgttttaaatgaaaaagactgtaaattcaatgtaaatattacctaactttatgtaccaagttaggagagtggaagaggggaatttttcaaaaaataagctgtatttgaacaaagcatgaaacttgttgttttaaaatttaagaataattgaatttaccatctaattggcatccgtactgtgcattgatagtaatatccaaatcatcttattcttccatagaggaagcgctcatataaatcacattgctgagaactatataaaactacatagaggtaaatggtgcttattaaatatgagtatagtttgttacttgctggaagtcttctagttcatttggaccattttcttaccctgaggtgaactcaatatctgttggcaatgggtggttaaatgtgaagtgcccttgttcagtgtcccttgttcttgtacaggtattttcttagtttaaaaaaaaaattctagcatgccaacatttgtctttggcctattcctttttttctgaagtgtgtaacttctgattttttctttgctatgttgtaaataacagtagctaaattctctgttttactatctacttttcttttcttcccagatcatttcattctaaaattaaattgcttggttttctttagaggaaattgctacatggtatacttgtagtagtgattcatattaaaaaaatagctggtaaatctttctaggtagtaacttatccaaacaatactttgagtatcatattttgtgaatgacttgcttaaactgggaaactgaatattctttttaaatcatataattcctgtattaaatgtgaaacacacagtctccaaagtcacctgattctctgtggaaaatgaaaggcattgaaggaaaccagatacattaatacttagttttggttgaaagtgcaacattactgtacttagaaggggcttggtttatttttagatatttaagctatcattaattttagaccaatggctaataataagagagatttttggttgctcatttatggagagacaaagaacagcatggcataaacaaacatcccagaaataaatgaaaagttttaagtgataaaattgtgttttctatgaaccagtgttgtacatgaaccaacattgtgtttcttagctctgacctgtacagtgaggtacctgtcaggacccctagtcttggcactggaaatgacaaagttctcctattactaaattctcatgccttccttttctgacttagtagattgaaattggtaggtactaatgatttatgtttgataaacttaagttctgctgatatcctgttactggtaat

SEQ ID NO: 15593 - DNA, 1229 bp, Homo sapiens
tatacccaaaggaaaaaattcaccatgtgagcagttatttgttaacttgcccgtgtgttcttctagattattaaatgaagagggcagagaccttgattcataatgatcactcacataataaacatttgaattgcatcattctttttttttttttttttttttttcattttgagacggagtctcactttgtcacccaggctggagtgtagtagcatgatcttagctcagtgcaacctccgccttccgggttcaagtgattctcctgcctcagcctcccaagtggctgggattacaggtgcccaccaccacggccggctaatttttgtattttcagtagcgatggtgtatcaccatgttggccaggatggtctgaaactcctgatctcagatggtgaggagggcctttcaaagtgctggtattacaggcgtgagccaccacgcttggcctgaattgcatcattcttacatagactttttaaaaggcacgcttaaaaacacattcctaacatttcttaacttctgaaaccaatcctgaatataaattctctttcttggctagggagatcttgtgcgaaaactcaaagaagataaagcaccccaagtagacgtagacaaagcagtggctgagctcaaagcccgcaagagggttctggaagcaaaggtgagtcctgggatgctaaaataggaacataagtaggtataggattgttcatctttaatttctttggatgggagagacctagaaaagtttctgaacaagtatcatttggtttatctgtttatccataatgccgccttctcctttccctctacctggtagactcctcatcctttcaaaatgcaactcaaaatgtcaactttttaataaagccttcctgaccctgcaaatgctggactcaatacgctatatgaatttccatggaaaggattgtgctcttctttacgacttctcttatgcctgaaaataatgatttttgtttgtttgtttgttttaaggaaaaggtctgtttatttgatacctgctcccagacctttcaaacaatagatctcccatcaccaaacttaagttgttttggggttttaaagtaaccattttgctatagcaatccactgacaattcaaatattgctttatattgcttatcagtatctacatcaaagtaaacttagtcttgttttttttttgagatggagtctcgccctgttgcccaggctggagtgcaatggtgc

SEQ ID NO: 15594 - DNA, 1211 bp, Homo sapiens
aatgtatagaatgtgcaatacactggaaaatgctgaggtgaataagatacagcttctgtcttctaggcgcttaatatctaatgggaaaggaaagttcaatgcacatttaattactccattgaggagagggtggtggctattaatagtatatttgcttgactggatctttaaaatacagagaaatgcagaaatgcaccttaaatatgttcagagtagtaaaattcagctttgaaaacttatttaggtaatttcagattcttgccaaccaataactattataattgaataagaggtattttgctttatctttcactttgaaacagtgactatatgagttttaggtcccagaaggatatttttttctctcttgataaatggaaagtgaataaattggttatggttttaatgtgggtgtcctgaaggttaggttaattgtgatgttcctgaattttgtgtgattgtagcagtggatggctagggttatatataatactttatatcttatgccttgttttctctgtcttttacactaatttctttatatgtcttttagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtatgtatcacttattgtttacctgtttatgtaatgaagtttttaaaattgcttatattaaaaggtaaatatcaatgttatgaaggaaaaatttttaaaaagtgatatacagaagtacagatgaatgtattatggagaaataatggcagaaataaatcttttaaaaaattctttctgaatataatttcttttttggcatatatgtatttttttggcataaaataaagtctctgatcactatatcttctagttatagctgcatagggtagaagggacagttgaagaatggttttaaaagccgttgaacttattgctgaaggatattttagaaaccatttagtttagcatgctactgtccaacggaactttctgcagtgatggaaatgttctgtaatgtgtgttgtccagtatgattagctaccagccacatttggctcttgagcactcataatgggtccagttcttctgaggcactgaattttaaaatttatttcatcttaattgaaatttaa

SEQ ID NO: 15595 - DNA, 1200 bp, Homo sapiens
ctgcatgtcactattcaatatcttatttcttatttttcatgtgatttttgcgtatgttttcctaatttaaaaaactatattaatctgcctttaacaagttattttcagttaaaagtaataatctttttggatgtagctggagggaaggaattaatacttcagagaagttagatcatgtttattttaaatagtgagtaataaaattttcattaatgtgtttaaaaataaccttcacatgtaccccataaatttgtacaaatataatacatcaaaaaaataaaaataacaactacccagacaaatttaattcaaaatttttttggccattcccttaggaaaccaactttctgtttagtgaaaaagaccactatagtatggagcctttatcactagaatgcagttgaaaatagaggccttgttttttgtttgtttgttttttgtagttaaatatgcaggtttatcgcttacgtttttgctttcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacaggtaggattctggaggtaacttaacttagattgtgcctgttcagggtttgcagcaattagcaaattctatgtgttctgggtgacaagatattttattttggcagtcatttgcttttttacagtacttggttttgtacagaatttgttatacagtattattatagtaagagaaaaatcacctgaacatctcaatttgtgggccttggggctagcatgaaaaaaaatgtttagcagagcacttggaaaatagatcttggtttgcattgtgcctcaccaatctgactcaacagtatgtactactttgggggagacagcattggacccacagaaagcaagccatctgggtttcagactcttctgtattacccatagcagtggaataaggccttgcatataagcactttgtaaatatttgcctggagaagtgagtgcgtgaaaacttgccaacagtagctgctgtccactagtggaatgagttgcctcagggagcagtgagcttcctggccctgaaaatactcctggcaaggttggacgatagcttgtcagccactttgca

SEQ ID NO: 15596 - DNA, 1119 bp, Homo sapiens
gggtacctggtgaaagctttttccattaaaagatgagtgccatttgatagtagctgaaataataatttagctcacttggtctgaaaatcagcaaaatagaaattttctttctttagtaggcagtgaagttatgagctgatttcttaggggtaggtcagtgacaggaaatagatcttgttttgagcattttagaaatacttatcagaagttcttatgctatgggttgggtcattgctgattagataatatctcttttttctcactgtaactggaaaagtttctattgatggtgttaattttggatgagagttgtctgaatgattttgtggacaggtgtttcatcttgccttaaaatcagcataaacaggatctggagtactgatagagagctggcatggttttaagttgatgattgattgttctcaggctcattttctgaaatactgaggcagtgctgtagttttggattccttgactacttcatacaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaagggtaagatatcagatgtttactcttccatgggctccagtcagttgtgtcatctgccaggttctgaaaggatgagattaatttcttaagattttttgcaggtaagtactgtatcttggctgcatttaaaagactgtctttgccgagattttggcattatagcctgaaaaaagatttgaaatagaatatactttttttttttcctagtaactgtcttaaacaaagagacttgtccagccaggctgaggaaggaagggttagaaactacatctactatctctcaggtcacttctctctcctttttggaggtttagaatactctctgtaattgtttaagcatgaatataaacaatagagaaggccgggcacagtggctcatggctgtaatcccagcactttgggaggctgaggtgggcagatcacgaggtcaggagatcgagaccatcctggctaacacagtgaaaccccgtctctactaaaaatacaaaaa

SEQ ID NO: 15597 - DNA, 1056 bp, Homo sapiens
ttaaacttttctgtttcacttggtcactgaggttcataggtttttctcttaaaagacagaatgggctttggtttgggtcactgccacttgtttgaatatttaggtagtctccacagaaagtcttttatgtggaaccaaaaaattaccgtcttttatatacagtagctttcagaatgctttcacatcatttgacttttttagtaacgggcttgtgaagcaagcagagcaggtggtagagacctgctttttaggtggagaaactaaggttcagaaagagttcatgacttggcctaaattcggagctgaaaccaggtgtttctgatgctggttctgcttctcttttgccatactgcttttcatgtcatgttttctggcattttggtaatgacgttatgcttgaacacttgctgaatattaacctcttttggtttgggatattagcatttagatatttacaaattaacatatttggatttttttctttttaaatcatccagttcttcagtttccctgctgtagttgctccattcaaatgttccgtcctcccactgagccaaaaccaggagttcatgccatttgtcaaggaattatgtaagcaaattcaattgggtaaactccatgggaacaccatcaaggagactgaattttaggaaatgtatcatttatttcaataaaaatatagactgaataaagaatataaatgattttataaagagtacatgattttagcctgtactcttatttctaagcgagaggatatgcttgctcagatgttttattctggcatttgagtgaggcaaggtaggacccaagagtcagatttaaaaattatttacttctcatactgaccttggtgccaagttcatcgagggaacctgagtggagtgtagcaaccataatggatctacagccacagaatccacagccctgaaaggaatcctggtggtcatctggcacatccacttatttcagagctgggaaatggggagagtccattgacctgcttagagccataaaaatagaggtggtggagtcaggactcaccttctggccttg

SEQ ID NO: 15598 - DNA, 1158 bp, Homo sapiens
ctgggggtggagaggcagagggggcaggcagaactttcttagttttagcaagacctccagatgattctgacgtgcactcaagtttgagaaccattgctgtgtggcagccagtgtttggttttggctgaggaacagtagccttggtcagagctctccagtttgccagtcttatgtaattccctcacacgagttacttgactgagtcctgtttgttctaatagttaaatttaatacacatgaagtaacttcaagggacatggagatttagaaaagttaggaaaggctttgtggcagaattgagttgtctgggggaactggtgggcgttttgggctagaagagcatgaacccatgcctggcatgacattgtttggctctgtgtaaggtttcctgagttcaggatgaatcttcttcttaaaaatctgaacaagttggttgatacttggcttctctttccttgtctctagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaaactactcttatgtccactttacaaaagaaaacagcattgtgattactcccagggaccgtattttatcttcagtggctgcctgattttacccccacaattaaagttgaaggaatcctgaacaaacttgtgatctatttgcttgtgtttttacattttcagcaaggctgtttctcccacgtttgggtagacatgctcatggcttaatgttaaacacagttaacactttttaaaaaattaacagctttattggggtataatttacataccataaaaatagcctgtcttaagtgtacagttcaatgatgtttagtatatttacagagttgtgcaaccaccaccacaaaccaattttagaacattttcatcactccaaaataagtctcatgctcatttacctcactcccattctaacctcagcccaggcaaccactcctctactttctgtctattgatttaccttttctattctttatcttattctgagaaaatgacgcagtgtgcaggtactgtgacagca

SEQ ID NO: 15599 - DNA, 2276 bp, Homo sapiens
taggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatgctgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcggactttctattaacatttctagctaagagtttgactcttagtggtcactttactgactttccaacataaaacaagtatctcagaagatacaactttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaacgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctc

SEQ ID NO: 15600 - DNA, 1436 bp, Homo sapiens
tagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttagtatgtgtgtttcattcccgtgcttctgttctgaagtcctggaatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctaggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctgtcagggtgtgttttttttaacctgttgtgtgcgtgtgggggttaggattagtaaggtgaactgttcaggaattctctgcactagctgtgcagaagagcagataactagcgctgctctggcattaatcccaggaaccactagcagtagtggggcgccgccaatctaacatgagcacaggtgcttcatgacaaacattactagcatgttcaactgcaccatgttctggcactgtattttgaatgacattaatttattaaataaattgtatatattcaatatctatttttcttttgttatgggaatggtctgctttttaaattttgattttgctaggtcaaacttagctagtaataggtggtttcttccaaattttgtttgatgaagattgagagatatgcataggctttccttaggctagtgtctttctaccctgctggcatgttagaatcatctgattctgatcatcatctttagaagcttgagatgatgcctgaacctcaccccaaacaaaatggtttctttttagagcacatcat

SEQ ID NO: 15601 - DNA, 1191 bp, Homo sapiens
tttgtgaacgtgtttaaaatatattcggagaacgagaaatctctgtgtaggagagcaggttttttgtttttttaaaaaaatattttttcttaaatattatgatcatttgttgctaccagacaaataactaagagatctggctttggtaatttaagttgtctattttgaaagagctttaaaaatgtgtacttattcatgtgttcgttattttctgtgacagttatattttgtatagaaggcaaaagttaacttgaaattacaactggtaattttcttgttttttaattttaaatgtagactaagaatcttcatttttgtcatgtttcacttttatggtaatgtctaaagttgaacttgaaataaatatgatttctatttaaggctgccattttaaacgttatattctaaaaccgtactggcctagatactacaactgaactttttttctttttagttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcaggtaagtacttttaatgttttaaatagaaattctttgaaatgttatttaattttttaaaaagccacatctcaatttttgtttttaagttttgcttaaggtttctattcagatgatgtagtacttggcaaatctcattcttgcatgtgtaagagacacatgaaagaagttttataaaggttgaaatacaagaaatgtgttgcaattaactaaggtaaagttttaatgttgg

SEQ ID NO: 15602 - DNA, 1152 bp, Homo sapiens
cctcatgatctgcctgccttggcctcccaaagtgctgggattacaggcgtgagccactgcacccggccgtgtaagtctctatttctaaggaggcttatgcacgttttggttcctttttatagttttcccatggaagcaagagggaaaagatgaatgtatgtgaagctatggagaggcatggggctacacgggagatcagggaacccttcgcaatttcttctcattagagcgtgtttgattagtggaatagctggcctgtttttgtctatcactagtataaatgcatgctttttatttctttctaaacttgaggacatctgccctgtgtttgggggaaaagatccataaatgtctatctctaggatgggtatgggatcatcgtttagctgatatttgggtaagaaaaaccgtacggagagatgagttggaaatatcctcatggtgtggaactttttccctttctcattacctttcagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatggtaagtccgtctccttcttggagccactctttcctacccttatttttattgcagtggttaattcagttgtcaccacatgaaacccactagacctttcggtctagacctacactggccaatatggtaaccactagctacatgtggctattaattagctaaaatttaaaattcagttccttggtcacactgctacattttaggtacccaatagcctcacgttgctgaggaccaccatagtggacagtgcagatacagacccagatcatttccatcactcagaaagttctatttgacagtgctagtctggattgtctgctgtctgatgattgagttgcagaaatttccacttacttatagtcattggcattcataagtaaccccctctgcccctgttgtacctgccatggccttggccaccaacctctctggctttaacatttgtgaaatgagacttgaattagacactataaaagttgcagatatccaggtagaaatttagccatacaatgtcagaattgccagatttcccc

SEQ ID NO: 15603 - DNA, 1157 bp, Homo sapiens
gtacagttctccagaaccagaccagagatttggaattttctcctttaaatgtctgtggtttgcatttattcacaaacagaaacccacagaggtatgtatttgggtttgcctgtgggtgcctgcccacctacataaagccttgattttccagcatgagtccagaaaatatggtcatggtagtctcttatgtcattaataccaattttctccttttgctgagtcaggttttagattataccatcagcccatggttggacaccatgggggcccattcaagacctggaagaacatttgtttccttggcttcaaaacctcaagaaatgaataacaccaaccccaagcctgttgagttgtaaagtacttcctaaatcctgtgtcccgtttaatcatcttctcccattccattctagggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccaggtaaggaaatgattaaagtcttcaattgccagaacattgtattaaataaagtctgccattggctggaccatgatttaaatactctgtccatgctgatttgtagttggcattttcatctctaatacaagtttctgttttctgatacttagttctttcctcccttccttccttcctttctttctttctttttttttgagacggggtctcgttctgtcatccagtgtggagtgcagtgcagctgcatgatcgtggctttctgcagccttgaactcctgggctcaagcaattctctcatctcagcctccttagtagctaggacgataggcgtgtgccaccatgcttggctaatgttttattttttgtagagatgggcttaagtttcttcataggctcttgtaaccatttctttcttgggggctgttttagatggttctgcaggaagacaggagagactcaccctcgactcccaccatccccctatactgtgcttagttatccagttataaacctcattatggggcccaagatgaggagtggccagaagtgatgtcaaggag

SEQ ID NO: 15604 - DNA, 1114 bp, Homo sapiens
atccaggagctcaagaccaggctgagcaacatagtgggaccccatctctacaaaaaaaaaaaagtattagctaggtgtggtagcatgtgcttgtagtctcagctacttgggaggctgaggtgggaggattgcttgagcctgggaggttgaggctgcagtgagctgtctatgatggtgccactgcacaccagcctgggtgacagagtgagaccttgcctcagaaaaagaaagtatagtgttcaatttacattagctccatttctgtgtggtgcttctcataacccacactgcattcataacctgatgaaactggagggccacatggcgtgtccctacaggtggctgttcacatgctgtgtgggggttcttatttacccttccaggggagcatgtttcctggctgtgtcgtcagatactgtggtttacgctgttccggagtctggaggcctctgtgtgcctttgcatctctttcccaactaatttgcacagctgctgtggaggccctcatgaatgacctctttctttcctttcttcttttctagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagaggtgagcatcagcatcacctgccttcctcactagctgtggctgcttccacattgcttgaaacagggcttctttttctttttcttctttctttttgagatagggtctccctctgttgaacaggctggaaagtgtagtgtgtgatcatcgtgtactatggcctggaactcttggcctcaagtgatcctcttgcctcagccttcagagtagctggcactacaggcacgcaccaccacaccctgcacagaacttcttgagagccaaaatattgaagctaaagtccagcttaagactggaattcccaaatagatttagtttctagagttgtcctgttatttctccttgtttctctgcccattttcctttaccttttgaaaatgttaaatcctacaccaaagtcaaaagcacgttatggtgaattccactttg

SEQ ID NO: 15605 - DNA, 2685 bp, Homo sapiens
ttacctatttttatgttcatgtctaattgtctgtttccactagaatgcaagcatcacaggggcagggtgtttgtgtattgatgtatttcaagatctagaacagtgtgctcagcacatagtagaccatatgttttgatcatatgaatgaatgcctgcatccaagaatgttcttacagtcttgggtggtcttgggggtcagcctttggtggggaaccaacttgggagaaggaatagctctgacggctgctgggtattggctacctgaataataagggctcttggagtcatttagcacaagggtttttcacctgcatttagagaaaaaaaacaaaacacagatcataggtcatatagctgccaaaaagatcttgtctgtgttggtagcccagactcaagttccagccctgtcacccccagactgctctgtttctggccccaggcctggcgttcatggcggctgaactcatggtctttcctgtccccttcttttccagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgatattatctggttttctgatattttattggaaggctgaagacctatgagaatgcaccatgcagtcagaatccccttgatgaaaacagcaggacttcactgcatttactgagggagcgcactctacttatagggagtgtcagtcagggtcctggccctcctctgggactcctgaagagaagctaaggaaaggactgtttagaggggtgtgggcgaggctgggggaactgaggctgttgagtgccagtgacagcagtgttggccaccgcaggaggctgctaccaccagggcctgagagctcaagaggaggcagtgggagcagcacaggaagggctacctggaggcgtaacagagggatgcagccagctgcatctgacagtgcggctgacactgcagcagagcgagggacaaacgccccatcccctctgtgcccccattctct

SEQ ID NO: 15606 - DNA, 1157 bp, Homo sapiens
ttgtatttttagtagagactgagtcctgccatgttgcccaggctggtcttgaactccgccttggcctcccagaatgctgggattacagatgtgagccactgcacctggcctcattatttttatgcttttttgagataagttcttgctctgttgaccagcctggagtgcagtggtgcaatcacagctcactgcagcctcaacctccccaggctcaggtgattctcccacctcagcctcctgtgtagctgggactacaggtgcatcaccatgcctggctaattttttgtagagactggggtctccctatgttgcccaggctgatctcaaacatctaggctcaagcgatccactcgccttggcctcccaaagtgctgggattacaggtgtgagcctccgtgcctggcctgcttcattgcttatgatgatgaaaaggagtggtgggggaggataaggatgggcattcccaggacaaaaaggtttcctaacatgtgaccttgccttccagccacatctgactgaactagagactgctgctcacactggatggccagaatgaatcagatcatgctttgtgtgtatcatagctcaggtgcttatataagcaaaccaattaggtgttcataggatctggaattaagggtaagaatcacggtcaaattgatcacaatggcaggtctaaatcctgaagatgaatgatgaggcagagccagagatgtggagtgggtagctggactgtacagagagatgctggctcctaatgtcgcagtgctgctcagattcagtcaccacgagacccagctccactgcttcctgtctcggcttctgaaacttgcagacttgtaccttttactgatgttttaaatgggagaaaataattttcagaggtctcagtattttctgaagggcagacaaaattttccctgaaatatctttagacttaaataatttctgaaaatattcaatctaaatagccactatgacaaggactttagaatttatatatcacaaaagacaggcagacggagagaaagaaacaagaagaaaacaaaaaaccatggtaggtgctcaataaatatttgttgactcagtaaagatagttttgaccatagaattaaaaaggttttgcatttcatatttattatcagtgcttcaatata

SEQ ID NO: 15607 - DNA, 1198 bp, Homo sapiens
gtccctagacgttactaaatgttccgtggacaaaaatcaccccatttgaaagccactggactggagagagagcattttggggagaaaagctaccatgtggaaaaatgtctgtcagtgggtcttaaggatttgaaaatatttcttcatttcaaagattttttgaaagtgaatttaatttattgcattttgcccaagagatctaacaacgagattcatactgaaattatttgtttctttgccctgcatgttaattttcttttgttcatctcttgattaggtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaaaaagctaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaacctttttaattctatggtcaaaactatctttactgagtcaacaaatatttattgagcacctaccatggttttttgttttcttcttgtttctttctctccgtctgcctgtcttttgtgatatataaattctaaagtccttgtcatagtggctatttagattgaatattttcagaaattatttaagtctaaagatatttcagggaaaattttgtctgcccttcagaaaat

SEQ ID NO: 15608 - DNA, 1206 bp, Homo sapiens
atacttgtaataaaatttcagatatggaagtgatatatgctacttgtaataatgattggtgttttgtgatgttttaacctttccaagatggtttcacattattttatttcatttcattgaacctcttatttttcatgagaaataggctcagggagattttagtgacttgcccaaagtcacggatgaattagtcagaaagccaggactagaacttggatttctttattgaaagaaatagcacttagggaaggacctcagatctgactttttcttggaagctctgttggcttcaatctgaaggcagtgccttgaggcagagtacttgagcctctggggttgtcacattggctgtttattgttatatttatttttcagtttagaatgttatctaatgaattgttttgtttactcacagtggctgtggttatgagatctttttgaaattattttacaactttttggttacgtctaaagctaatattggaaaactttaaaaactttctctgtttttcagaggtaccgaaatgctacatttggctgtgttacattctagaaaactttgtgtctactctgtctcaggtaagaaatatttttaccaatgtagaatttatattacaaattgggcttaatgttatatgagaatagatattccctagtgctgacttggtagagaacacaaaacatttagttgaatgttttcttgtcttggttaacattttcccatttttcatttattctttcagatacttaggctattacattttcatggtctactatttctgtgtatatgtatctttctagcagaggattcctcttaatcacctgcctctccagaattgtttccgggattgcctgtgactaatagaggccaattctgggtacttaagacacttgagtcttaagaaatgttctacaataacaaaattgattagatgctaagtcatagtggtttgaagtacattttctttggtgaacctcaagtattttctctttaccgttccaatttcttggtttttggttgtcttcactcagtcaggcttcatcaggtttcattctctgacatggttctgtgggtacaagtatagtgtgcggtttggtttttattaaaattatagtatgtggtttggtttttattatattttattttggcctttattaaatgtaagatataacttaaaaatttttatttcaattattagataagtt

SEQ ID NO: 15609 - DNA, 1142 bp, Homo sapiens
atgaggactcaccatgttgcccaggctggtcttgaacttatggcctcaagtgatcctcccaccttggcctccccaagtgctgggattatgggtatgagccacagtgctcagcccacatatttatattaggaagttatttgaaattgacagtactgaaataatttttctcttgctttttattacctttagggttaaagctttttgatagaagcttccttggctgaatgtgttgatttatgaaggaagttgctgctttttaaatacgtttcttttcagtgaataagaaatgttggatttagatcaagttgatgcaattatacttaataacagcattttgctcagagtctaagatgttttttttctttccactcccacctacttggcagctttagtcctctctaccttgtttattacataccagttccaattctgtctgtgttttcttcttccttttcagattaaatctcattctcaattaaattgttttttatttaattattttcaatttttgtaggtcagactatgggaaaatgaaatcaatacacaggttacagaatcagaagagcccagcatcttacttctgctgtggtcagtttctcaagtggcaaataaagatcatcatttatcagtaatgttactttctctggagatatcaaataaatatatctacaagtgtggaagtccatttgaatgaaacttcacaaagatgagaaccattctaaactttgctggcagctcacagcaagctttaaaatcttattgcagtacttattgcagctcattttttagtttgagcaatttggtctagtacttcaatgtttttcttcctaggctaggtccacaatagtcacttattttaaatttgttacttaacagtttcttctttttaaaaaatttcctagcttatttaaatttttttaaacatttattttagatacagcaggtacaagtgcaagtttgttacatgggtatattgtgtgatgctgaggtttggggtacagattctgtcacccgggtagtcagcatagtacccaataagtaggtgttccacccacagccactccctccctccccactcttgtagtcgacagtgtctgttgttcccatgtttatgtccatgtgtgctcaataatactttgttc

SEQ ID NO: 15610 - DNA, 1167 bp, Homo sapiens
ctttataattttttaaaatcatgtggaattaaatgtttttgttttttttagttagtaatttatcaggggtgtgtttgtgtgtttgtttgtgggtgtggcttttagcttttgacttacactaataaaggcctttcctataccaagatcattttaaaaattctgatttttctggtgcttttattgtgtctaaacttttaatctctgcattgattttgctgtaaagaatgagaaaagatttctattttttcccatgtaaccaattattgaaaaacacttattaaatgatctgtttttcctccagtgatactggttaacttttacaattttccatttgatctgttccactgtattatctgtgaattagtgattcatgtaccaaataccacattgttttaattcccttaactctataatgcatttaaatttcttcattactcttttacttttattatcattgtgtgtattttttctttaaagatgttttttgtgtccatttaatctcaatttaagaaattattcattgcagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtcagtataatatcagtaacagttttctattactggctatacttttttttgtcaccctagagtcatgtaccagaatatccaagataaggtactcatttccagtgctttaaggaacagtgaacagtgcacaagctttagagtcagaaaaacctaggttcaaagtcaaactctgctgctttctaattgtgtgaccttgggtaaattacatgagcgccctcagtttccacatattacctcccggagttgttgtgaggatttttaatcttttatgtaaagcaacaagaacaatgccaggcacgtaatatgtgcttgataaatagtagctattatgattagtattatgagacaattcttggtgcattccataattattaccataattctccaattgtcttaccaagcaactggctcatacttctagtattatgtcagttgatattttgagatggaattcttaagcatcatagttcaaaaagttctagttcaaa

SEQ ID NO: 15611 - DNA, 1143 bp, Homo sapiens
aagcctggtggaaaagctgtgtcagcggttccacacagcctaaactgagcaggtgcagcaggacctggcctactgtgtgtcacagctgcccctcacagagcaaggcccttgcaagatgcttggcaattttgactgttttggagataaactgtcagatgagtccatcttcagttcttttttgtcagttatgggcaagctacaacatggggccaagcctgagggcaaggctataatagatgaatttgagcaaaagcttcaggcctgtcatgccagaggtttggatgggattgaggagcttgagattaaccaagcaggtagccagagagccccaacagccaagaaaccatccactgtttgtaggcaccagcctctggcttctgcagcctcagacaatgacttcgtcacaccagagccccgtcgtactacccatcggcatccgaacacccagcagcgagcttccgaaaagaaaccaaaagttgtcttctcaagtgatgagtcaagtgaggaagattttttagcctagatgacagaagacaggacacccaagaaaataacccccattctcagagcatcagctcgcaggcacagatcctgagaagtcatcttgcctgttcctttcctccctgtgcagggtaacttgtagggtgacctagaattctaattctgttccccttgtagaatatttgcctgtctccttttttgaaaaaaaaaaaaaatacatacacgatctttaaaatgcaaggcctttctcttaaattagcctaactgaactgcattgagctgctttcactttggaatatatgtttgccagtctccttgttttctaatgaataaatgtttttatatacttaaaaaaaaaactctcttcctccccagttcatctgcatctcattattgggctacaagaaacagcagcccgaccctatttggtccaggaacaatattggatagaaataaaagactaagggcaaacacagaaagagtcatcttaaaagatttaattaagtgcctgaatttaaaacattcaacagatccccattcttagaatggaaatttctcatcagccttggaatatgacggaaaccttctaaggatacgaaattgaactttaattgtgtcagttattacaataatcagggccaa

SEQ ID NO: 15612 - DNA, 1958 bp, Homo sapiens
gtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaatgagggaagtgtttttcttgattgttattttcattttcaccttgattgtgatcaagttcagcctcgttttgtagtcagatagccatgaactggtttgagtcagatggcagtcctgagaagagagggagggatcataaacagtgggggtagactctttggtcttgttgttggtagtggtaggtactgaggttatccaaacttttcctgtatttgtggtagagtcacttacattccttttttatccttttcatcaagggacacagtaattcattcaaactatatattgggaataattaaagggttgctaaaagctgttttaatgtatttaaaacatacattggtatcaacattttctaaattgtaactcaatgtgtttacttgatacaaacatcaactcttggttctttctctatgtaggaaagacatttcagctctgttcattcctgtataatttctta

SEQ ID NO: 15613 - DNA, 1344 bp, Homo sapiens
taaagtaatttaaggggaaaaaaggaattgaggtcaggaatgtaagaagtgctctgctttctctgcagttatataatgcatattgatttttaacatgtacattcatttttctaggcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattt

SEQ ID NO: 15614 - DNA, 1220 bp, Homo sapiens
tatcacactattttaattattaaaagtggtaagacttaatatctgttaaaacattccctttaattttcttgttagttttctagatacattttagacacttggaattttgactggaattattttatgtttatgaattaatttgagggagaattcatatcttaaataattcggtctattccagtagacccagtatcttttacttgtgcaaatcttcttttgtgtctcttagtagagttgtagagcttttgaaaaacataaatttagcacttttttttggcccatattttgtccttacccatggatgaacaattgaaaactgaccagtgaagaatctgcctaggagattctgagccttgttttactacatttaaagggagccaagtggatggtatggaaagggaaaatatggtaattgtcaaagtatctcaaaagtattctagtaatgaaaattgtttagtatattttcttaagatgcctctgtattttttaaaataggtaattttggccagttggtaccggatttataccaaaataatggacttgattggtattcaaaccaagatatgttggacggttaccagaggagaaggactcagtcctattgaaagctgtgaaggtaagtttctttctgtaatattgtccagttatctgttgtaacataataaacttatctagcataataaacttacactgtaaacttagtggtataaacaacacccattttattatgcatatatagattctgcaagtccagaatttgggcaggctttagcggggctggtttatgtccatgatttcagggacctctgctactaagactcaaatgtctgggaaggctggaattaactgagaggctacattgctcacattttggctcctgggcatggaggactgtgaggctgagctcagctggaactctcagctgggacacctacatgtggcctttcggggtgacttgggctttttgaaagcaaagtacctcagagtagtagtaaggcttttcctatggcagctgaaggctccaagctggacactgtatgacctcttatgacctagcctcagaagtcacatagtgttgcttctgccatactctgttgaaagagtcacaagcccaatgaaactcaaaaatgggggctatagaccccatacctccagaggaggcgtatcagtgaatttgcagccctgttttaaaaccatcattgctaattaccctggtctca

SEQ ID NO: 15615 - DNA, 1199 bp, Homo sapiens
acttgataggagggaaaataatctgtaaaattaggtggcacccgagtgaaattcatatgtaataatacatcagtgtgtagccttctcaacacatttgcatttttgcatgtaaatccggaggaaaaatgactgatagtgtcattttggggattaaaataagcagttagaggagtatttttggcttgagatttcttggttcatgataaattttagttccataataaaccactcactctattcataagatagcattttctaagagtgatattagtataagtaataggattttctaagttgaagtatgctgagtcgtattattttttaaatgctgaaactttttgaagctattttgcattcagttatttcaattaagatgcatttatgtgaaaatacatagttttttcacaactttaggatttatcagtgatcagaaacctgtgaaattcattgtattaatagctattacttaattgctttgtttttcaaaaacagtgtatttacttagaagtggcatcataattatgtaccttttgttattttaattgagcatatctttatttcagggactatattattcctatttcaagactattgtggaagcaccctcatttttgaatggagtatggatgattatgaatgataaactgactgaatacccccttgtcattaatacattaaaaagattcaatctttaccctgaggtaaggtactttttccaattgtgatttttcacttttgtaaaaacttttttgtattaaacgctgattctaaatctaagatataattcaatatattaaattgtatttaattttttaaaagaaaatatgtatcttgtggaggaatatgtaaaaaagatcattactgattttgaggagagggctttaattctgtggggaactgttgatttgattgcattgtttagaaaatataaaaactagatttggtgtgcttacagggattataccaagggagcgctgttacttttacatgtcatttgttaaatgttttcttccctttcctcatttaattgagtgcactttcttgagtgggagtggagggaaggtgagcccaatccagcaagtggagatgacatttggcctctcctttatcctccttgcaaaactataaatttgttgatgtggaactctagttcaatagaatatatattttaatgattttgtcagaaggctttccagata

SEQ ID NO: 15616 - DNA, 1229 bp, Homo sapiens
gttgcactggtaagattgtttttttctcctatggtattttatgcagacgtttataacttgctaaagctatttcccatacatttaaaggaataatttcagcatgatcagtatgaatatatattacatgtaacacaatagtctgaaaaactagtttaattgataaatcagggtcagaataatataattgtttaataaaaaagagattcattattaaagaggctatatttgagactccactcaacattaatatgttcatggtgagagagagattaatttatttaatcttctagatagaaatatgaatttcattagatgtttctaaaatggtaacccaatgacatttacagtttaatctatacttttattgtacttcacttaaaatattctggttcattttaattttaaaatctaatttgattttttagagagggaaattttagtataaatgcaatacatactgagtgaaaaaaatatagatactattgtatttgagtgttattacaaaattatctgcaagttaactgatacttttatttttgcttttagcttactttaaaaaataatacttagagtgtaagttttaacactattgctttgttttgtttttccaggagccatataacacacctctttgaaaatgaccgtcatttttctcacctctcaacattggaaagggagatggcttttcgcactgaaatggttagtttttatttgggatttcatcatagtactttaggaatttaaaaacatttaatattttttattatggaaaatttcaagatgttccaaagtagaaagagtagatgctccaccttctacagctgacagccacagccagttttccttcatctacacccccactcactatgtcttttttattttttatttttatttattaatttttttttcgagacggagtctcgctctgtcgcccaggctggagtgcagtggctccatctcggctcactgcaagctgcacctcccaggttcacgccattctcctgcctcagcctcctgagtagctgggactacaggtgcctgccaccatgcccggctaatttttttttttttttttttttgagacggagtctcgctctgtcgcccaggccggactgcggactgcagtggcacaatctcggctcactgcaagctccgcttcccgggttcacgccattctcctgcctcagcctccccagtagctgggactacaggcgcccgccaccgcgccc

SEQ ID NO: 15617 - DNA, 1555 bp, Homo sapiens
aatcttttaatttttttcagtgaaaaagtagtatctgaaaatcccaacattgttgtaattgggttagctgttgttatcatgttgtctatcatgtttataaaatggttactcatcttgcttattttccttttatcctttagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgacttgactgcagcctcaaccctctgggctcaagcagtcctcctgcctcagccccctgagtatctgggattgcaggcgtgc

SEQ ID NO: 15618 - DNA, 1170 bp, Homo sapiens
ttatctggagctggatggtctaaggtggccttattcatatgtttggtagttgatactgaccatcacctgggccatgtgtctcctctagtagacttaacctgggcatgttcacttagtggcagagagagagagagaccccaaactgtaaaatctcttgatgcctaaaagtctcacaatatcacttgtaccatattttattggtcaaagcagatcacaaggccagcccagattcaagggtgaagaaatagattctgtcttttgatgaaagcagaaaaaatttgtggccgttaaaaatcttatataactaactttacatattttattccttctgtaatattcctgtaatagttatgacattggggtactcatttagtgaatcttgacataattgcttaggatttcacttttgaaatgtgtttaactgtcatcctgtatggcaattggtgattttagaagatactgcaattttatgaacctttgattaaacttgtgttttaacactgatatatttatttatgtagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaaggtaaaagactttgtggggaaaaataacatttactttttttttcttttgaaggagacaagccccaaacatttcattagcatatagaagaaccaagctctttgggagacaaatgtaacagcctctgggggaaataacagccttctattctatttcagagttattatattaggcctagaacctatagggttggaacggtttcttctaaaaaatattttaaattaattgattgaactttattttcttcattctgaagttatccttaaaacctcaagggaagaaaaataaaggagtagggtaacatttatacttacagtagtgtgtagtttttttatcccaggggtggcagaacagctggccactgagtttgggtggtgtctccggtaccagcaaggcaatggaaggcacactgcccatgcttgacatttaatgaacccttttcactctctatttgctgaaccaactctctaaagtttaggttgttaatctccagaagtg

SEQ ID NO: 15619 - DNA, 1164 bp, Homo sapiens
tttatttactattgtcttaacactatataaagtgttatgcatatattttgaaaatatgatttaaatatctttatttttatttttccataagttattggggtagaggtggtatttggttacatgagtaagttcttcagtggtgatttgtgagattttggtgcacacatcacccgagcagtatacactgcaccatatttgtagtcttttatccctcgccccccttccgctcttccccccaagtccccagagtccattgcatccttcttatgcctttccatccccacagcttagctctaaatatcttttcattaaggtttttataatataaattgtgtctgcttgaaaagatctttcatatcagatttctaagttgctgaaagagaatggggttttacatacttctggttgtaactaaaatcatttaaaagaatagggaggggtgatgttttattaatttgttgagtatctaccctcaagtttttcatgtgagaaattacaaatttgaatgtcttttttcatcgtttttaatgtagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacaggtatgaattgtatagatggtatggcccatacatctgttccaataagattcagtttggtatgttgaacattttatcagttaactcatgaaaaataaatgcttttgttttatctatatgttgagtatcctttgcttgcatatggtttgtctaccagtagtataagttggttatgtttagactgaagtagatcacgatgtggttcttggactagttcatagaaacctgatcttataactgtattaccttaatatctgcaatgaaaaacacttgagaacaaactatacgtgttgttagcattgctgaccctcagctccat

SEQ ID NO: 15620 - DNA, 1164 bp, Homo sapiens
aacagaactgatgaggacaatctcctgtgtgacgaaaaggaaggaggaaagtagcatgtaggggtgatggtagtcttagagttaggatagcaaaaactgatggactttcttctgaaagctcctgttttattcatccttaggaaagggaaggtgacaggggaaatactgtatggaggaaagaagagagagctgactcagacataggaagaatagggggtagtattgaggcttagatgagatatgagaccgtagattttatagtggaaccatttgatcgtttactttgctttttgtgtttttaaaaaatttttatgtattttttaatccactcatctgcatgctaattacattgtttttacacaaccaaagctgcttctaacttgagagacaataaagtctggaactagacctggaacaagagtacctgggtttgtatactggctctgccagtcactaactgtgtgcaagatacttaacttttttgtgtctcagttctctcatctgtaaaatggagatactagtacctaacatagagggttattgagaagattaggtgaggcaatagatataaggtgcttagaaaggtggctggcacatattgagctctgtataagtattagctgcctttattttactcttatttgattatttctactatgacttcattcataaagtcttcttttatttctttgctgaaataatctgtacaacaatataaagtctttaaacatacaaaatagtgaatgttcctcttaaataaccttgctaatgaataaaaagactcagacgagggaatgttttcttctcttctcttctttccttaccttctgatctgttttgtccttgttttctcttgctcttaccctccgggtaactgataattaaatggaatcctgatgtgtaggagctgtcaccagatgttataggtgtgggttgagataagtgacataggggtgggtgtttttccctttgtgtggctttcactttgtttttttattgttattttattttattttattttattttattctaccaaatacccagacttcaaggagaggctttcactttgattggcttatctaaaactgagccctgatatgaattttcattctttcttgccacctcctctccaaaaaaatttttacatactgagaattaccaaga

SEQ ID NO: 15621 - DNA, 1808 bp, Homo sapiens
gctgtggattagcatccataaaaggtggttaaaggtaattcatttactggtttatttagtcatttttttccctagcaagagtacatgggggtatggaatggagggagaagaattctgacctctttggttgtttgttcctgtaggaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaatcagttgtttaggaagcactgtttcaatgtgtggcatggttgctctgcatccctgggctgggagcttcttgagggtactgtgctgacaatgtctcatccatctttttctctctacccagtttggcttattgtgtgttcttagggctgctattgaatgcataagtgaatgaaggatctatttctgaggcatttcaactgaatatggtaattggatgtgcatttgaggatagggagtataattcccaagtctttagcagatactgaatggatgagtgatatcatcagccaaacagggaataggtttgatgggactgataagaaggtcccttgtatttatttatagacttgca

SEQ ID NO: 15622 - DNA, 1102 bp, Homo sapiens
agtgtttaatgtgataggacttaaacattctctttttgctagggtctataaaacatttgctattaatagccactacttttcatttttatctaccaaatttactaaggaaaaaaaatatgccaaggcttctattagtgtgctcaaaccttttctattatctggcaaataaatgtcactcctcttaaacctgggacagttcacttggaaagggacactaggtggtctgccctaaacatgatgcttcacatagtagggctctgacttgtcaacctgcttctgactgtgtcttttggtcttcctcacagttttgctgaagtaaataaggtgatatttctatagtcattggagatactgaaactgaaatacatcttccccaagtttgcacactaataacagtaaagccttggcttaacaccagaagtgaagtctaaaacattcaaccaggaaagcacaggtttgctatattttgaagttcatcgagtgacctggtctgcctgggccttccagggctcccgctgaggaatacaaactcaccctggccccagttgtgattcagcaccagccactgtccactccagctgaaatcctaatggggatgattccaagactaactagtttctgagatatcagcaaggattccaggaatctcccaggtagctgagtcccatttcttcagattaatccacagagaactgagcttggagagtgttagcaacatggagatcccacttcccaagacaggattgcctgccgttttcccacctaccctacccctcctctcgacatcccctcttccgccactgaagacaagaagttcatcacccacccctgaccgagaatgagggttgccgggggtatggaacttatttccagtggtgtcagatccaatcatggagttttcttgatttgtgtttcttctttgtatttgtagagccagacgcagaagacagatcatccgatttctagagcaaagccctttctctactttgctggcacacttcagaattatttacccctcccttagtgtgccaggctacagagggtatgcctatgcctgcgtagttcttgtctaactccttcctgtgaaagggagagcagtccc

SEQ ID NO: 15623 - DNA, 1168 bp, Homo sapiens
aacttagcaagatgctcagcagagaaaataatgaatcatcttttgctaagcctgtgagaaggatagaaaatattatacgggaggtcccaggagtagagtgaaaatcatgtgggctttgaaatcaagcagactttagtttgaatcgtgcactccttcgtgtgagctggtggactttggtcaagtttgagtctctttgaatctcaacttctccattttaaaaatacagatggtgataattggattctcaggattgtcgtgcccaagaagcagcctagtgtcaggtggcaagcagggattctggagccacattgccaagttcagattcctgctctgacatttactagctgagtcatctgcagcaaattacttagcctttctatgttcatgtccttatgtttaaaatagggaaagttgccatgaggaatagttaatctatgtaacgttctaagatcactgtgaagcacataagagctgcatgtgttcttgtggcaataccaggtggcattgagcagagatgccccacctgtggtactccccacctccatcttgctctcttactctccctgttcttttcttgatcatttttatgtttcctgatcattttttaaatgtgaaaccagccctattgttgtgattttcctaaaggattgtgcagaccctgtctagtgtatatccaccctcagagcagaagttagcatgactttcatggaaagccaggaagggagctctcgaggaaaaagatgagtgttgttattcagaactggggttaaggtttcatttcctttttgttatgaaaatatgttctgcaattgaaaacaaaagtgcaaagcgttctgaaaactaaaagtaatatacatgtttcttgagtaaggagtgaatgaactatttagaggcatataatacacttcacttattcgaagcattaaatattccagttactcattcattcaaactttcttacgtagcagttgtacatggttctatgccagattctggggatagaaataggaacaggacagtccttatcccccaaaactccaatcaaattgtctatgaatgaaattggtgatcaagcagttgaacaaagagcctctcatgactgaagatctaaaatgccaacagagagcacagagacaaggagaggccagtggcccttttgttaggatga

SEQ ID NO: 15624 - DNA, 1126 bp, Homo sapiens
acttctttgtttaaaactgccaagtggcacattcattcaattcattgatgctaatcatacatggaggaaaaagaagacagttcatattaatatcaacacattcctcaaatcatttatcacttacacgtaaagttgtagagaacagatttgtcagaattattgattgagaaaggaaagagccctttgttgtggaaccgtagattggtgttttctcttcattgctgcttctgcttcgagaaggagtataaccttgtcacgtgaaacagcattatttggggagcagtagatacaggccaagtttttaggagtctcagttaaaaacccgtggtcttaatattcagtgttacacaaaggattccaaatataaataaccttcacgctgacccatagattcaggtctgattcccatttcacaaatgggaatacggccaaggtatacagttaggtcatataaaagtgacattaaactcatattggcagaattccattgtggtgtgacttctgcaataatgaatggctgaaagtaggcaagataatgtaagacttgaatggggttgcattctgaaaggaaggcagccagaggtcctcagaattaaatggaggacctgcagtaaaaatatggctctattacaccaagcattttcctcttttcctttccattgcctgtctgagatgatttggcagagtttaaaaataaatgaagtatattcatttttccttcagagtttttctttgaaggcatttggtaaggggacaaaatgaaatatgaacacaggcaggatgggggatcaagacatcaaaatgttagcattatatccaacatatatatccttatgtgaggaggtatgcttgcttccaattaagatgacatcatacaggcggatgtgatgcttccaagcagtgttaatgatctgctaggtaatgcagaggaaatgatgtgtttggaatgggtttttttttcccatttgtacctttccacttctttatggactgcaacatgtaatgattgggattaggttttttatagaaacttgatttcaattttcagtactgattagagacaggattcttttgcaggcatatcagttatgttgatcattgcttttcacattttattgtagctgcc

SEQ ID NO: 15625 - DNA, 1259 bp, Homo sapiens
tctcacaagagtgtgactttcacatttccatttgtgtgtgaataaccagcagagggaagagcattggccaacttagagcagaagcactatccatgctttcatagagaagcaaaatctttgtccttagataaaggcctgattagcaataataactattgcagcctttagtacttttaatttgctgctatatacagctgtgactgtggtcaggcccatcacccatgaccactctcacccagcactaagggctgtgactgtaagagtcgaagggtctggccctcagtcatactgtggggctttcatgggcgtgcttggtgcataacataatctctgaatttcacctgcacttaatatacttgttggtcattgcctccctgtcaccttctccctggatatacatctcatccttgtttcccactatatttctcatttgtggcatcttgaaccaacaccaattgaaaagaaagaaaatcaggaaaaggacctaagcttcagtcaggtcctaacctgagtttcttcctcagcacagtgatctcacttgccatatcatctctgtcatcccaacgatctgtcctttgcatcttggtcatcgattgaattccttgaaatagaccccagtaatgcccttctgtggagagcactggtctggaagctgcaatccagagctgtcatgtgtctgagcagctatgccggaggacaggcttgattcaagaagggaagtggagaaaagaagcccattaatttccttaggattataactgcagcctcctaagtgtacttcgcttgattgtgagagactttgcatttcaggtgcaaatcatccctgggaaagagggaaggaggagcagggaggcctttgttcaatcaaaccaaaaaagagaattaaatcagtagtctttgaaattggctaagggactaaggccactttgccctggatcatttcagctctttcatgtgctgctgtgtgaaagccatccagtcctcagctttgcgagctggggacacctgttcctccaggagaaggagacctcaccagttgttacggatttgggcatcagatgtctgctttctgagagatctcatttatcctgcttttcctaaattataaattctgcattttgcagaataatatctgcaaataataatgtttcagatattattgttgttgatctaggcacagataagctgtgtagaaaatattatgaaagttctgcagaggactgactctggggatgagcattcagacacttaaatcctat

SEQ ID NO: 15626 - DNA, 1104 bp, Homo sapiens
agagcataaaagtcatttgaaggtgattgttttaaataattaaaaaactaatagtgggatttataatggtattctccaaggcaggagagaacttcatgtaaaattcttgcattcaggatcagaagcccttgtgataggcatagttgatacgaggacttttgccatgatggttaaccttcatcttgccccttactgtccccatctgtaacatagggatatcatcatcagtcatcatcagtcatgatcgtcatcattctcatctgagaatcaggtgaggaaatgttagttaaagtgctttgttaactgtaaaatgcactatttgtggaagaaataaattaacttgaatatgcacaagcttagagataccaagatgcatcttgcagcaaagccaactgtttctgtgcattttgtggatatcctaagaatctgaagttctgtggtgctttgtttgtgtttcagaaagcagtacttggagatacttctgaaattgcaggaaaatgttcatccccataggaagtggttacagagagcaactaaacttggcagtttaaaaggagactatactaagcacatctcaattataaatggatgaaaataatatttatcatagactttttaaggacttattcctttttacattatttctgaaaagatatagctggccccaatcagcatccattcctgttgtctcttagaggtcatggctaagaggtgagcctggtagatttgcccaagctggtaatgagagatacagacctgttgaaaggcacaggctcccattgtcttcttaacgccttatagaaacacttctggttcatctcaagcatcgtttgggtgactgttctgattcctcgcctcatcttcactgtgggagggcattacagctccctcagaactcctgtagcactttatctgtgtctctttgttatgctttctactgtttattaatacatacccttttctttttctttcattcctggcctcacttcccctaaaaattggggtggtttataggaaaccttgaagataataaaaaataatgataaatggtaaaaaccacggcaaataaaaagtaaaatgaaaaaatggatgatgaaaagtaca

SEQ ID NO: 15627 - DNA, 1357 bp, Homo sapiens
atattacattatttcattttattctcatattcagagaaagccacattatttctgttttataagtaaggaaattgagcctcaaagggagtaaagaacttgaccaggttactgagcgggtaagaatcagagttcgagtctcaaccttatccctgcttttacctgcaaagcatcccatccaacgcctgtcagagatgtcactcatagaattctcctgtatttgccaagtaaacaactccccgaagcctggatagcaccaagcccattttctcactccaattagattgaaatataatctaaacatgtatttactggatttgcaggaacactattttttgtttgttttttgttgtatctgtttaaagccttagaaccattgctttgtttggagtagcctgattccacttcagtcaaatacttttttaaaatttcatctttttttgacttggggccagacacattcacaggactccattatctggggtttctttgaatttggaatgcttttaaacacttataccttatttctgctgttactgaaaaaaatgccaccatggtcagaaggacctgtgctgttttttcctttgcatctgtgaggtaggccttactgagagaggcctgtgctggggcctagggtaaagcttcctcctctgggaactcccttcccttctagggttcccccaggggtggaggccttgctttcccatgcctctgggatgtaggagattctcagtttcctggcacaaacggagggaagggctgggctagttttgtcggggaggaggttgctgttaggcgggcaaatggatccttttgcttacaacttttaccattattcagttcactatttcaatggcaaatatgttggtgagatcccttccaaatttctctacaaatacttatacttttgataagcactatttaaaaaacttgttagttaaaagatttggtagaaaaatcagaaaatactgactcaaaaggaagaagtttgaaagattcctgtaattatattcccagaggcagaaccacggcaattatttacaactcttgtgactttcatggtgctacttccctgtttgttctgtgcaaatattctcctaatacatcattttttttcaccaaatgtgagcatactacatgcattgtagtttttctaaacttcttttaaaactaaacaatattttgtggacatctttccatgtcagtatatctggattcatatttgtagctatctatacttttacataattttaatgctataaaatattccccatggattctcacatttactccaataattccttactattagaccaaaaaatggaggcatggatatttctattttctctttgaccaagct

SEQ ID NO: 15628 - DNA, 1099 bp, Homo sapiens
aaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagcactgaacagggagtcaggagactattgtctcctaaacccaggactagagttccctcgtactgtcactcctttggtcattaaatgcactgggcttgcccgcactttggccttcctagaacactgcttcataacctctctgtctgacttctgcatctccttccaggtcagctcattcacaagagttgctcccaagcctggatgagttgcaccttgcatcttgagcatgcatttctcacaataattattaagctgtgtgataatttctgctttcaggacactcatccattatcttggctgtgagctccttgggtacgggtaccttgtatgtttacttttatatccctagcacaaagcaagtgcctggcacatagtcagtgccctaagtattcgtagagtgaagaatgccagcctctcttgtccctggtttccttatgtgttgaatgtggttgagtttgtccattgctagggagagacttccagtaataaaatttactattctagatgcttctactgttatgttttatctgcccatttatctttcttagttaccaggagaaatgtgtgacacctatattataatgaaaacaatctcattacttatagtttatctatattaaacaaatttaattgcattttaaagcattctttgatactgttgcttttgcaataaatatggataatcttggttataagggagttaaaacaatgctgtaataaataaagtgcttcatgtgatcaaaatcaaatttgttatcctctctcaaaagcctgctctccctcttaccttccctaaactccagtgtccatttgccaaggccagaagcttccaagtcattcttgatccatttgtctccctcagtcctcactggcagtcaatatcccgagtcctatcaaaatagctcttaaaacttctgcctcttctccactccctcagccaccaccc

SEQ ID NO: 15629 - DNA, 1242 bp, Homo sapiens
atgaaagctgctgtacatccaaagcagtcatgcttaatgggctccaaagtggaacacattgttaaatccctttaagtcatcaaagaaaatcattttaacctcataaatagaaggcaattgaagtaaattgtagtagcagcaaatctgcctgacagtttaaccacagaaggaaaaagctgccagattgtgagtcattgggaagctgggatagaagctgactgggtgggagaggtagccaaggtcacggcgcatggagccccagtgcctgcctcctcagcccccagcacacctcagccgcatctctccaccacagtcatgtagacgcgaagcaaaaatgtgggcatgctcgtagttgagccttttctaaaatgttttaacatgaattctaatgtgaccacacgcatggtccttcgtgtgtctgtcacagcccctcttcagcacacagacttttatgtacatgtaaggtgaccgtggcattttgccttttaatgctatttattaaatacttttgtcttctctctttttctaagtgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttg

SEQ ID NO: 15630 - DNA, 1354 bp, Homo sapiens
gagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaattccttttgatgagtctttttttttttttttttggaaattttgttccagtcggatactctgcttgaaacagttggtattggagttgttatttgtgcagaaatatgcttgttcttccactaggttgcactccacgcccccaccgcacctccccacttctttcattccagtcattgctggtcactcggtgttccctgacatccagcaattactgcagcaccaataacagctgccaacggagagcccttaaaggtgccggctgtagactcccagtccgtgaatcactgataatcttacgaccttcataatcagcaatttcttctcacaccagcttcattttctggtcactttcctttttggcatgtttatgttcgtaggta

SEQ ID NO: 15631 - DNA, 1325 bp, Homo sapiens
tgtcatattcctccaggtcacattagacgtattctgctgttgggtgtccttggagtcacagagtaacagctgatctagactaaatcctatgttaaccagaaataaactccagagaaaggagtgccatcctattacttcctctccaccccctgactaacgctaccttagtgtttctgaatatgagagtagaaaaagaagatcattttttaaatatgtgtttttaaattgcatttttagaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcgccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttcctt

SEQ ID NO: 15632 - DNA, 1107 bp, Homo sapiens
caaagtttagcaatttgtaatttctccacagatctgatagatttttcttcactagttgatcttttatagttgctattttatttttggaatgttttctgattgtaagtttcctgaggcctttcccaccatgcagaactgtgagtcagttaaacctctttcctttataaattacccagtcttgggtatttcttcataggagtgtgagaagaaactaatatgtatggctaactagaattaatttgtatgatatatagaaatgtaatttaaattaatgtttctctcttttcccccactaggaaagagaatactgtgccaggcctagactggacatcatccagccactttctgagacttgtgaagagatctcttctgatgctttgacagtcagaggctttcaggagaatgaatgtagagattatcatttaggtaggagatatgaaagatctggctgatatgcttttttaatgtttttttctcccccttcctacttgcaataaatggaatttaaattaaggtgctgaaagaatcttaagagaatacctgcgtagactgtgtgtgctgaaaacaaggacatttggatgcagagatgttgcaaaacttgcataagctcctatagtaaaagggaaggctagagttcagaccaggacccgggggaggattgggccccttgttttttgttcttgtattttttctattgtcctaactatttaatgtgacacataatttaatgtcaagctgcatggctccatggttgtcatatcactcccattttatgtgtcaggaaagttcgctctggggtggcagagaagttgtctttcttgtttgtaactgagtgctcagagcctgaaagacttctggcacattttaggtgttcagtgaatatttgttgagtggacggagaaatacacttagtcactgctcataaatacagggagaaccattaatatttagtcataccagagacatctgtgtttggctgttatcatacccttgtaaaatatattaatgaaaatagaacagttcagctttgtaggaatgctgtactactttaaacacaattgacatttgttgagaatattttcagttctcattgtggccaaaggaaat

SEQ ID NO: 15633 - DNA, 1188 bp, Homo sapiens
gctactggggaggctgaggcacaaggattgcttgagcctaggaagcggaggttgcagtgagccaagattgtgccactactctccagcctgggtgacagagcaagactctgtctccaaaaaaaaaaaaaaaaaaaaaatccgacagccatggtgttaagtccctgtagtcttcgctacttgggaagctgagctgggaggatcacttgagtgcagaaggttgaggctgcagtgagataagatcaccccactctacttcagcctgagtaacagagcaataccctgtctctaaaaacatgaaatacagaagttcctggactgcagaggaatgttaatggcatgctgattctacctgtgttccatgaacatgagcctctgtactagaaccaagaatgaagggaaagagcttactggccttgggtctcttgccttgcctcacatgttgtaggtctgccaggtcttcccatgagaataccctgcatgagcataaatgaaaaatggtaaagcaagattgccccagagctggcacagccagagtttcaaggcccagaacccagacattagactgagtggtgtggcttccttagaaacaaatttcatctaaaataagttacttctgggtgctaatatatctgaggtttttaaaaagggtgataaggaagcccacagaaccacacttttctgacattttagttactagaactgctgaggccaccaaaaatgttgtgatatgtaaagggagtgggcagctgaatgcatatacctgcgtccttacctaatatatatcctttacactacttattaactgctttgtgggaaaccaaaataaaagccttcagcccagtctaagttgtgattctaccctcttccaactaaggttagagcttagttcttagaactaagtttccagtctaagatacaggagagagagagagagagagagagagagagagagagagagagtgagtgtgtgtgtgtgtatagagagtgattcaccaatcaggcttcttgttctacagaaattctcaaatctctgtcatgaagatactttaccgcaacagttgcctttcttgattttgcccctacgtaatgccttttctgaacaaacatgctggagcacgagtctgccatcactgtctcaaattcttaatttctcatgcactctccacctttaaactactttttgctaaa

SEQ ID NO: 15634 - DNA, 1873 bp, Homo sapiens
gcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatctggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgattttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaatgtttgtggtgttacttgatgtttacaatgtaacatgtaacattcaaatgtatcaaatgaggcatctttaccaaacaactaaatcttttgagctctcagtttggagacttcttttgtgtaatgccagatttcctaaataacagtgtcagcattgctcagatttaatcaaggctcagaaatggaaggactc

SEQ ID NO: 15635 - DNA, 1113 bp, Homo sapiens
acagttgaggaaggtacttttgagatgtggcaactgtctcctggtaaaagatttgtcagactttaccctgctgctactactaccattgatgtagccttattgcctacttcttttttctgagacagcagtgatgccttgtcacatttttcgtcctaatttttacatttgtagaccagagcgagatcagggcaatccattttgaagaaaactatgatcaccaaataatactctactttaaagaaatttttatttttcaaaacttcaaaaatgtaactttgaaattaagtaaatttctattttatttcataaacttgaattagcactgtctttgtaaattccaaactgaacctttctcaattactgattaaatcttaattatttctcaccagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgataggtaagtgcaaaaagtatttgtcaataactgttcaaagaaaaaatgtaagtctgaagtgagaaat

SEQ ID NO: 15636 - DNA, 1789 bp, Homo sapiens
agcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaatggtcaacgttatttttgttttgttttgcagattatcaaagcctagcaaaatgcatttaaatgaaatagtgggttttatatgaaaactatgggtggggtggggagggaaagtaagtgccttaacaggtaagcttaaggtctgaaaaaaatagttaacttttacccccatttgtcttttaaagggaatcaatgcattaaaaaggcaagaaactctgaagtttcaggggctgcctgttcagttcctgttaggtccattccctctgcttgtcacactttctccttttctgcctgtctttgggctgtgttgcctttcactaccaccttctcttgataggggagtgagagcaaagaaagggagtagaactgcaatcagtacatattgtttgagaagttctacaaagttttgtcatttaaatggttgaaagtaatagctccaggagaattttagagtaccattttctttcaggctgccatattatccctgtttccatttgccatggataattggagggtcatggtatagaagcaagagttaataacagaacttgcctaaatgtgttaaagttcatgggggaggggtggcaaataccgtattttaagttatgcaattgcccttttaagaaagtcaattctattcacttgttaactagaaacattgcttagattgaatttattgaagcaaaaagaaaaggcaatgagagagaacttttatcttccttcctgtcacattctgtaaagttgattatgacttctgccagacttagagcaacaactttagttcattttaacatttttttttaatgaagagcatcaaagaatggagtagtccttatttaaactgtaatggtgtcaagtctcactgtgtgcacactctcacacatacacacacaattatactaattctagaaaggaaccaaaggtaaataaccagtgtttccattatcactaaatggaaaaattgactggaagttagagttgtgccaattaatc

SEQ ID NO: 15637 - DNA, 1214 bp, Homo sapiens
gcctccaagcctctctccatttctctaacctatgcattttagagcgagaggaccgcctcactagtgtcaccatcctgccttttctaaaacatgcaggctcacacattctactcctgcttaatgtctgtgttaaacgttttctaaccatttttgttttatttttctgaaaaagttaacccctcccaactcctcacacattggctcttcctcttgagccacaaagttttgattcttgcgatgtatgtgccttattttatgttaatcttgtcaatgagagggaccagttggtgttgcccaatcagcactccaaggctgtgtgtgcaccagccagagagcgcacggtggtagcagagtcgaggctgtcttgtatcctggtttcatgtgttgttttgaactgataggaggatgttctcttctgacaagttacccttgtgtatcctgcagacatgtaaaataaaatacaagttcatttttttcaccttttttagatttttttaaaaaataaaatgtgtaatcctttttttaaaagaaacacatgtaaatacatttaagtattgtaggcatagcgttcagatgtgactggcccaggcgttcctcggacaagcctgcattccccgtgatcacgcccacctcaagcccaggggctgcagcccagccacagatgaactctacctttgctttcagaaccacttagtccttttgtaacaaagaaaaaaaaatgtttcttacaatgtcaataaaaaattctttgtatggaaatttttattgggttgtttattaaatgcatagttgaatggaaagattgctttctttgaaaacatccagagcctgtagctggatccagacccctcacgtagaagatgaatggacttttgctgtgagatccagattccttagccctaaactggagaataagatgcaaatacatacatgctcatggtgttttgaggatgtgtacccggggggcacaccagttgcaacaattattgtgtttctttatattattgctttctaaattcagtgaggaaggatggtgatggggtttaacgtctaacaacttaatttgtccctcttttgtatgttatcctctcatttcagagatgccctaccacatgtcaacagaaaatctgacacgatagaagcctactttatgtggcttttagtaactgacctcagccagaataaattgtctcccatgtttttcttgtgtcagt

SEQ ID NO: 15638 - DNA, 1507 bp, Homo sapiens
ttccatctctttcccattttaactgagaattgattatatatagctctaagtatataggtatttaaacaaccccacaagcggctgtatcagtaacatttattaattccactatagtgagggaggatttccattctaaataccttattttgagggatttataaaacttagttgtaaaagagaaagcccacatagtgggaataaattgcttcagccatttttagtatttgagagcactagggaagatgtttagtagctgtgtggatgccttttttcacaccctgtctattgaatgctgcatccattcacgaagttaaatgttacatgcagttagtccttaatgtggactggatctgtacttttgttttggattaaaacatttaaagatttttgaagtgcagctactccccacgtgcatttgatacacataaaagtcatactgtgtgtgcacaaagagtacatggattttccagcatattgctttaaaaaattatataaactgttaaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagtgttaagaccagcccacttttctcatgtttatgttctttcatttggaccaagaatctccgcatggaggttgatttgccactggggactttggctaagactattaggtttgctttcaactagatgttcctgagacaagcagagggacactgcaattccccttccatgcctgctgttctcccccatgtaagtcttctttgaaattaacggatgtgtctcctttggaacagccccataacaaaagagaactactgatctgagcataggaaagtagaggctctaccacttttcagttgaaaaagcaagactttctctgtgtttctgaaacaaggcataatgttgtcacagaatcagagatccagtctcacttttccacaaatctccaaatctccagtcttatcttgtgtgctctaatggtttggttcaatccctttccaactcttgttttcaaagcatggggcctgagtgttctccactcctcctaagaaaggagcttgggtggaagggaccatgctgacctcctccatcagagggctcttccagtagtattctcggatgcaacctccatttctcagttaccattatttcctgtatcagctttgtccttcctggagggatgcacagtgatccggcccaccactgttgttgtcttgtgcttctgctctttcctatggtttcaggttattttctgggtttcccctattcttcttttatttctttttttttttatatttgctttcctttctactgcttttagatttgcaggagatgcaagtttcagctcaatgtttggcttctctcaatatggaaatttcagaaggacagaggagagga

SEQ ID NO: 15639 - DNA, 1097 bp, Homo sapiens
caacttctcatctccccagtgcagactgccgggtagattctggccttgggtacagtgctcatggccctctgccagtttatatgtacatatatttatgtaaaacattttctcccagctctttgccagctgttccacattttccagctgccacttcagtttgaaatgatggactgtctgcgtctccaagtcaaagaaccctttagtcaaaggtatggagggccggccgctgtgcaaatacatggcagtgccattagccgggctggtattattagttctaaaaaatacctcctgctccccttttcctctcctccctcttctctccagttaggctttccagagcacagtatatacactttgctgaaaattcgagtaattaggcctttccctcttaaatgtgatttttgtacagaatttggatgaggccgtttttttagatccctgaaatatgtgtctggtggaaataaattaacttttaaaaataaaagagtttcagcttgagcgcattgggcatggcgggtggggggcctgcaccctggccgtctgaaatgagctcttttcagtctatttaaggcaggaaccattcatcctccccatgctacactttttgtgttgtttgatgtcttagcatattatagaccgaaatctacaagaattgacctaaagtattaattttgagtatttatgtaattgctcggtaattttgaataggtgccttattgattgattcctgtaattatttcatttaggttttagattaaaaattaatagtagtctgacagtttcttaattacatgtgtcaagattcttttgaaggaggaaaatgctatgttttaaaatagtgaaatagcctcaaaatctcttaatttttctaaagcagaacagtatttcagttgaggggatatattaaagctgccgggactggttttaacaatgtaaactctgtgaagtatctgaagaatttgtttatgttaggaaatattggtcttaacgacctggtacacaaacactttggccagttaaactatattcaaacctaaaacaaacatgaaataacatttaaattagttgtaatagcatgcttatacagagtagagagt

SEQ ID NO: 15640 - DNA, 1177 bp, Homo sapiens
gggggaggaggagcgcggggaggaggaggaagaggaggagagaagggaaggagggagcgcgcgggaggggagcgcggagccgagggacaacttttccaccccgtgagtagtgcaggcggtgccaggtcggggcggggggcttctccacccagcacggggcaccaggccgggatgggacctttttccagaaagtcgattggatgccaggagaggcgtacggctgggggtttctttctttctctttcccctccctcccgcggttgaaccaaatcagaactgtcactcagggcttgtgagtcagaagggatcggattacacgatccccgaaactgatgccggagctgcacgagcgggagggagcgggcaggggcagcgccaccggcgcgctcgcacactcgcactcgcgcacacccgccgctcccactcacccgcgccgctctcccgccttccccgcgcgccccgcggccgcccgcgccgcaccatgcccgcggcgggcgcaccccgcgcccagcccggccgctcgcggtagccgtagccgcccgcggccgcgcggagcggggagccgccagcctgcgccccgtccgcgggtctatgggaagttcggggacttgacagccgctgccgccgcaggtacgtcccgctcgaagttctttgtttcgcggaccccgcagcccgctcctgcggccgcgcccgcgcctccggggccagaggtggtccccagcgtggggacgggatggagtgaaaatggctgtcaaaaggcgcccagatttagagagccgccggtgaggcgtccgagcaaggcttgcattcgctccctcctcctggaaggtcctttccgaagagtccgacccgcggaccggccggagacggattggagaatttcacctcccggaggggggacgaagtttgccgcagtggtggcggcgcccctcgcctccgcccccatccaaagggttcagaagaactccgcgagccccgcacgcgcctggctccttcctttgcgcggtggcgctctacggctcgggcttcgggcgcgcacggcgctcgggatgggcggaaggaggcgggaggcatggtgggtgcgcgcggggacctccgccgcgggggccgccgccgctggggcttctccagcccgggctatgcttcggagggcgggggtgtggtgtgagcggatgga

SEQ ID NO: 15641 - DNA, 1161 bp, Homo sapiens
aacttctgggtgatcactcactcccatatcccattagagtttgggagtgggggtctggcttagcctgcactgtggggccaggtatgcagcacactccaggtactgcccagcagcagctgcttctgctttacttggttcatttcccacacgtccctgtggtttgtctgattggggatctcttgtctttgcaggttgctttcacaaccaaaatttatcaccctaatatcaacagcaatggcagcatctgccttgatatcctgcggtctcagtggtctccagcgttgactgtgtcaaaaggtagagatgctgatggcatgctctgtgtgctcttttacacatgtttttaccccagcactgactgagtggaaatggaagctcagagaaagaagtcacctttcccaggtcacatagccctgtccactgctgtgcccttaagtggatatccttacacgcctacgaggcagcaccagcagaactttgtgccccgctccctggcgcttctcagcagtcaattgccctggtgtgctcaagactgtcacatgggtgcaagaagaaaatactgattctacttatatttttttatccaaaaataagaaaggcaaatattacattaccttctctgttccctcatttattcatctaataagcacaaaacggactgtgagtcagccctgaaggaagatacagggcatgcctccgggggcctcgaagttggtggagaaatcctcccttcccaaaataaatgatgttgagcacatgtctttggttgaagttgaagaaaccagtctaaactgagcttagaaatgcagatattccttctgaattaagatgggctgtgcatgggctatgtatgcacgagagacctgaatgtagatggtgcagtatcctggcaggtggagcgtgggaggatggtgaaaaatcaacccaagagaaacagagcctggcctaaattttaaatttttctgtagaggagacagggtctcactttgttgcccaggccattctcaaactcctggcctcaagcagtcctcccattgtggcctcccaaagcactgggattataggcgtgagccactgtgcccagccaagtatcttaagaaaggcaaacctgcccctgtcatttgtagctttatgtgtggggacctgtggtcagaactttga

SEQ ID NO: 15642 - DNA, 1144 bp, Homo sapiens
ggattacaagcatgcaccactatgcctggctaattttgtatttttttagtagagacagggtttctccatgttggtcaggctggtcttgaactcccgacctcaggtgatctgcctgcctcggcctcccaaagtgctgggattacaggcaagagccaccgcacctggtccagaatctcattttaatccatttattgggtgttccaagtctgtgaccttggacaagttacttgaatgctctgaattcttgtttccttaacagtaaacaggactcctaggactaaatgccagaggttcatgatgtagggtacagacaaggatgggagggcagttggagactaagatggggtgcttcagtggagaaggggaatgagaaccaggatgcacccaggagggaagtatcctagcacagcatgcctcaggccacacagtgaggaccacctcggctgatacatgggacggggcaagtggtgcatcaagcaatttagattgggctgttgaagggaagacaactgcttggtcaaaatacagagtgcaagttcagggaagtttacccaggggtgacccagcagcttcgtggctacagctgaccaaccttttcttttcttcccagttctcttgtccatctgctcgctgctctgcgaccccaaccccgatgaccccctggtgccagagatagcacacacctacaaggccgacagagagaagtacgtgtcctctttgggttgcctttgcaccatggctgccccaggcagctccatgcagtacctgtgctctgagctggtgcttctaggctgcaggttcccacagacatcttcctgcccatgctgagccatgtgcacagagggtgtgccctgggcttggactcctggctctctcactaacatgtcctttgagtctaaggagggaaaaggagataaaagcagttcccctcctggataactcattagctgctgctactgtatatgaaaacattgccaagccctgccctcaagaccagcaaaatcagtggtcagccaagaacagactcagaagaatctgacaacaagaaaaattctgatttaaattctagggtttatagcctaagacaaggggatgtctgcttggctataccgaaggtgaggctgagggcagtcaaggtgggaaa

SEQ ID NO: 15643 - DNA, 1214 bp, Homo sapiens
cctctgtccctgctatccccatctcccctggcccagacttctgcccttcacgcccatccctgaccagcagccccactcagtctgggctctgggtgccagctggttatagacatgccacctgaacccaggccaggagctggtggatgcgtggggctattttaagcacagcctcttggcctgcacactcccctggcccccagcccccagcagctcagctactggtcacctgccaccgcctggaatgctgattggcagttggctggggtgggtgggggctgggaagacactattataaagctgggagtgttgggaagcagccgtccccgtccagagtcctctgtggtccctgctgccaccatggccactcaccgcctcgtgatggtccggcacggcgagagcacatggaaccaggagaaccgtttctgtggctggttcgatgcagagctgagtgaaaaggggaccgaggaggccaagcggggagccaaggccatcaaggatgccaagatggagtttgacatctgctacacgtcagtgctgaagcgggccatccgcaccctctgggccatcctggacggcacggaccagatgtggctgcctgtggtgcgcacttggcgcctcaatgagcggcattacgggggcctcacaggcctcaacaaggcagaaacggccgccaagcacggggaggagcaggtgaagatctggaggcgctccttcgacatcccgccgcccccgatggacgagaagcacccctactacaactccattagcaaggtgggctgcctttgctgggaaggcctctgggaagctgcagagtggggagtcgggtgggggcccactggcttgggagggaaagcagcgtgcctgtgtcccccaggagcgtcggtacgcaggcctgaagcccggggaactccccacctgcgagagcctcaaggacaccattgcccgggccctgcccttctggaacgaggagattgttccccagatcaaggccggcaagcgagtgctcattgcagcccacgggaacagcctgcggggcattgtcaagcacctggaaggtgaggccaccttcaggagcctgggcagggtgggtgggcagcagccccagctggcttctcatctcagcaaagtctctcgcccatggaccaggctttctaggcgtggggctccacatcattcactgaaaaaggagggctgagaagccattttttagtttt

SEQ ID NO: 15644 - DNA, 1245 bp, Homo sapiens
gctgccacaggctacagcttctgccactgtgtgggcctgccctcagtctcagatccagaattcctagggagggactctagtggctgacctgaagcaggtgacttgcttgggctggggcccaccctctgtgggaagatatgtgagcaccccagccagccctgccaactctgctcctaaatccacccttttgattgttaactcctcattgttttttgctgttggctaaggaggagaaccacagaaatttgttccaccttctgttaggtgggagaggcatggtttttccagtgacttaggagcccctcgtgctgatgtgttagggtgactgttttgattatgttggaatcacaggctagagctgtgtaagtccctttcatagaggagaggagaggggtgtgcgtgggtttgttcccagagacggcaggctgggtagtcaggctccaggtttgaatccttgccctgtggtctacggcaggttgcgagtggggacggcgcctgcctggtgcatggtgctccatgggccacaccgtcccggagcgggtgatcatccgagtctagccatgagagctctgcccaaccgggctacgctccttccccacagctcttcacccagatcttcggggtcggtgtgaagactgctgaccggtggtaccgggaaggactgcgaaccttagatgacctccgagagcagccccagaaactaacccaacagcagaaagcgggtgagccctccagagaggctgggccctgggcttccctaaactgcaccctggatccctcagcatcaactccctagagggaagggagcagtctggtgcagagggtttggtggcagctttgtgtggtgggcttcctggggtctccacccagtgcagtcaggatctatcaaagccttttctcagtggacgatgctgaccacagcaacttccatgatatgccaggggcttgtgtctgcctactggttagactttgaccagtgaccagggacagcctgggccttgggcacactgcccagtgtggtgcttggtacatggaggcctgcagaggtggcactgagcagcagaaagaacatcagctttcaagtttgttaggcctgggtttgagtcttatctaccatttgccaggtaggtgaccattgcccaagaaataacctctctgagtctgttacattttctgtaaaatggagaaggaaggctgggcatggtgactcacacctgtaatcccagcactttgggaggtcaaggt

SEQ ID NO: 15645 - DNA, 2161 bp, Homo sapiens
cgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttcacagtggtcctgtgctttctttgtgcttcaggggaatcctttcttcaccaagcccttcccccgggggagagagtggcctcatgctgtgtgcctgtgggcctgccgcatgcaagggtccaagttatcctgaccagctcctgtccaggagaggtagctgcaggcctgactccttcacctcctttctatagaccttgctagcaggaactgtattttcttttttgctgttaaccaggtgagggagccctggagtagaagaagccctgtcattgctgaatcctgttgcctggtcttagctgcagccaggagaccca

SEQ ID NO: 15646 - DNA, 2008 bp, Homo sapiens
tgggcaccatgccctgtttgtgaggactgttagagccccagatgggcgttccccaggtggtgggtgcagcgggcccagagcccagttttacagggatagtagtaattgggttgggcaccttgaacctctctcccgagtgggcccttttctggactttaaccctctctgcagtgccgcatggcagacagcagagcctgggggtggatgggagagggggctgctgaggagctgacccacccgccccatttcagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctgcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaag

SEQ ID NO: 15647 - DNA, 1193 bp, Homo sapiens
tctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgt

SEQ ID NO: 15648 - DNA, 1149 bp, Homo sapiens
tcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtc

SEQ ID NO: 15649 - DNA, 1449 bp, Homo sapiens
agacttctgctagtgggtggccagaaagaagccatcctctctcccttcctgactcaaattgtacaactgctcaaaggaagaaaaagaagccagaggttcctctgcatcagccagaggccaatcaccctgatccaggctgccaagttagaacccaagctcccagatcaagggacaagtcagaggtggagctctttgatcaaggggcaggtcagagatcaaggtccccattgaggcccggcagggacgaggcaaaagactggggcaggctggcaatcttaaaccccatttgccccaagcccctaaaaaaaaaaagtattccataaatacttgctgaatccaagaaccaaacctagtacttagcttatactgaaagctttaattatactatctcatttaatccttacaacagccctttaattgttatcaccctattgtatataagaaaaaaactaagacctcagtaaaaaaaaaaaaaagaaaagaaaaggctctcttcctcggcgctgcctacggaggtggcagccatctcctcctcggcatcatggccgccctcagaccccttgtgaagcccaagatcgtcaaaaagagaaccaagaagttcatccagcaccagtcagaccaatatgtcaaaattaagcgtaactggcggaaacccagaggcactgacaacagggttcgtagaagattcaagggccagatcttgatgcccaacattggttatgggagcaacaaaaaaacaaagcacatgctgcccagtggcttccggaagttcctggtccacaacatcaaggagctggaagtgctgctgatgtgcaacaaatcttactgtgccgagatcgctcacaatgtttcctccaagaaccgcaaagccatcgtggaaacagctgcccaactggccatcagagtcaccaaccccaatgccaggctgcgcagcgaagaaaatgagtagacagctcgtgtgcacgttttctgtttaaataaatgtaaaaactgcaaaaaaaaaaaaaaaaaaaaagaaaagaaaactaaggcccagggagacgaaagaatttgtttgttcaatgccagacagcttatcagtgtcagagctagcaactgaatgcccggtctctagactccaagattcatactcttattccataacataatttttttaaaagggggaaaaagactagaatcaggaagtaaaaagataaatgtaacagtttcagagattaaaggagcaaaccacaaggcaagagacaggtatcctccttgctcatccactgggagagtctagaagcctgacaccacagcaccaactaacacagcaggcccagctcttggcttgtaatctcaatctcttatcaaaacccaaggacttcttggagaaagggtccattccacagccagggcaggagaagaattcaaacctggaacttcctgtagtgtacaagaaaataaagaagt

SEQ ID NO: 15650 - DNA, 1196 bp, Homo sapiens
atatgtacttcacaaaatgtttattaggtagaatttgaaatacaaaagacagtagacagaagaacatgactcctcatgtgctcattgcccagttccaacagcagcctgcttttctccctcctggtttattttgaaacaaattctgccttgtatcatttcatctgtaaatattttcagccactgtttaaacttccagttttcttatagtgtcctaattaaaagaaagttttgtttgaatcaggctactaataaggctccaaacaccaatgcctcatagtcaaccctccatttttctctcttttttttccctcaaaatttatttggtaaagtaaatcaagttgtttgtttgtatttcccactagctggattttgctgattattacccacatgtggtttagcatgtcctttgtcctatttcctataagttggagttggatttagggtaacatttttgaaagttaggagagtatgtaatagaagcaggttcttcctaaagatgactgttgttcaatatcatcttttgcaaaattttaatattttatatgtatgtatatattttccctactatatatagtacacatgcacagacaaaagcacatcagtgaatgttgcctttgtcatatccctggaatgtgctgtgaacccttgcactagataagcagctgacactgactgaatacttcctgttgccaggtagcttctccttagtgtacacataggtttttcactgtcctcacaactctttgaggccgttctgttgccttcccattttgtagtttaggaaactgacccaggctcatgttgttgagcagtggaacctagtttgcctttgggtggtttgccctgagattctccgctacgttaaaatgctgatgttcatattgtttggtccataaaacataaaataaaataaaatgcttgggtccttgctctagagatctgatttaattggtctgagtgtggcctcttctgtgtcatgtctggattttcagaaactttccaggtgactctgatgtgtggccaagatgtttactaactgccatgtagtattctgctgtgtagatcttattatttaatgagtccccaaggggtgtgtacttaagttgtttcccgtgtgccagcatcacaaatgatgttgcagtgaatatgcgtttaagtgtctcttggaacatgtgtatgaatatcagctaaatgaa

SEQ ID NO: 15651 - DNA, 1104 bp, Homo sapiens
atgtttgttgaattgaatgtccatgcagtgtggtgaaaaacagcagcagtcctgtaaacctggttccattttgggaattgaagttcagccatattttcatgtttcatttgtgagtctgaattttggtgcctttataacccacagttgtaccaggaccgtgtattctttgcattgtgaacaagactggggtctgtaaaataatgacaacaaagaccatctaactgtacatcttttaggtatgtaaatattgttagccttggcttataagtttctgattttgttgattttggaatcctcctgttaaacactgtttacctgtcagcttttggtgaagtggcagtgcatttccattttgccagtgggaaaacttgtcagtttctgacttttagttctctccttcacagattttacgacatttctacaagatatgtggtacagtattgggcagatgaactgattgctggattggtgtttgattttaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggtgggaatttctactttgcagcttccttctttcttgcgtaacatctggtgtttgggtttctccataatttattcttactttgtaacacattaattcttgatctcagtatttatttagctcttcatgtttgtaaactgctgcattacagtctttcagttatgtaggatgggaggtcagttggcttaaggtcagttccctcatttggtaaggtcagtagtcatacaaccatttgagatccagagccaaaattagagcacttgactcctctcacaaagacctaactttatctgtgtttagaggcttag

SEQ ID NO: 15652 - DNA, 1165 bp, Homo sapiens
aatgatgtatgtgaaaattgcattccattttataatacattagtatgttttaagacaaaaatcgtttagactgacaagccattcattataatcgataatgctgttttttttggagtccactttgagaagtgctcctttgtagaagtccttgaaactagaatcaggaaagctagctacatcctgttccttacataaattgttgagaaatcttgggagagtcacttcacctcttgtcagctgagaagattgattggaggttacagattagagttctcttccagccctatgttctgtgactctagaatgagtactgagaacatgtgatagttgggaggttggcagtggtagcacttcctggtggtgtgaatgggtaggtcagagaaggctggatgtactgagtgagcagaggcagctgcatggtgaggactatcaagtctgggggttctgtgttcgaagtctcaggtgttaggagagagagatcttgttgctttgcttttgtggagttaagatgaagatctggagtatcagcaggatgagcaactctgaaagcatggactcaaagcggtagagaccctaatgttagaatgaagtcagggcttcaggttatctgcagaagtaaaaatggttctggtgttgtttccagtttttaaccttttaggattttattgatttttttttttcccctctgcctacatcatcatctccccacactgtttggtgtgtgctgcgtagttttttacttcttttgccagcaggagctggggcaagttacgtaacctttccaagccttatttttttctcatttttgaaatgttgatgctgtcttcttcacagtatttttgtgagggttttgagagaatgtttgtaaaataatttgacacagttagtctgttagcacccttttgactgcccgcgcagtgcacagaacattgttatttaatacctgtccgcattctagccctttggaatctgactcccacccatgtcccaggttgctgtctcagcctttccttcctccagttattgcaagagcttttgcccttccttgacaagcctattcttagagctgtggcatttcctccagtggttccctgtggaagatgtgcctctcattcagggtctaactgggatcctccttgttccaagaagtctccctagatttctt

SEQ ID NO: 15653 - DNA, 1229 bp, Homo sapiens
gggaaatgtttatgttctgagctgaggcaggcttcacattggagtaagaattgcccagcatatctcatttctgtttatccatggaaactgtataaagatcacaagaaatggatcctttcagactcctaagtttatcataacctgagtttatctcttttttataaaagtacatttatgcacaatagtgcttttaaaataagttattccaagacttttaaaaactaattttgtcgtatgggtttattggtgctgtgttcctctttggaaaaggtttgcataacctgtgactcttttaaccctccccacagctcactggatctgcttaatgacttgcttgtgttattgcttccaggtcaggggtcaccacattgcaaaacttgatcctctcggaattagttgtgtaaattttgatgatgctccagtaactgtttcttcaaacgtgggtgagaattaagctgtaaatgctaattttaatgtaattttactttttttttaccccttccctctttttttttcttctgtccttttgtgtgtgtccttccctctcatcgttggccactcatagatacgagggcaccatgtagcacagctggaccccctggggattttggatgctgatctggactcctccgtgcccgctgacattatctcatccacagacaaacttggtgagggtctgagagcagtcagctgcgttgcttgagctcctctcgctgtgccacgacctgtggtagccaggatgtccaggcaggagggaaaggctcttaagtttcctttcattctgatcacttgaaatttatcggtattgtagccttagtgtgttttgggcaagttatttttatcttactttttcagccagattgtcttaagtctcaaaatttgaaaataaaattttggacagaaaggtttgtggcacagggaaaaagcttgtccacctggggcaggtggatcagaagcacttcagagtatagctcttttggcttcaggttttcaaatgtcagtgcagcactgccttcagtgaggcatgtccatgaggccttgctcaggaactgctgacacagccatccttttctgaagcccagtgtggcctgcccttgactggaggccatgtcccttaggggacgaattctagagcaagttgtgcagttgggtctcctgatttgtaattgctggtgatcacactgaggaaactttggaaggcattcccacagcgtcaggaggtcagggcc

SEQ ID NO: 15654 - DNA, 1790 bp, Homo sapiens
ggctactatgactacgtgaagccaagacttcggaccaccatcagccgcgccaagcccgtctggtaaggcttcagtccctgccaggaaggctgtgggaccctcccctcaggccagtaggcagttagccaggcacatgcagcagagggatgggctgggccaactcagtgtcccctgccctcactgccccctccctccatctctcaggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccaccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaaaggaacagaaacaactttgcattgcattggcttgacccataaactaagttatatccgtgggcatgtctgctgtgtctttctgtctgttctgccttctcccctgaggggatggggatgggccagtcccctcctaacccacctgggaagcagccccctcctcattggacagggggagtgatgaccaccacctgcaggccctcgccggcaaagccgtcattgtgaatgcggcagaggcggcctgggctgccgggctgtttgggtgcagtcctgtttctgagctttccctgctctgggtccttcccctggctccaccttgaaaaagtactctgcactctgtgcctctccgtttgagccagcgtgcctgcgggttcaccctaaccacacgtttgttaattagtgctccccagagcccaagcaacgattccaacctggagatggggcctctcaccagcacaca

SEQ ID NO: 15655 - DNA, 1093 bp, Homo sapiens
agcattaccggttctagcaagcatcagggtcacccttgggctagagaagaaagacatggcttatgagtgcactagtcagcctgggcatgagggccttggggacgggttggccacacaccacattgtctgggatgtggcagatgtcaacacagacccagcatctgtgactgtggatgtgcgagcagggggaacgttcaaggggacttgaggtgattctcttcatggagaagtggtgactaggcaatggttagaccggcaggatgcccagcacagctgtagagatggatacaagcgtgggcagggcgctgaggccaggaaaggcagctggatggggccaagccactgaggagttttgttggctgaatccccacccccagctcaccctgccctcagccttgtccctcccccacctggcagcccctgacacacaacccccagcacaccctttacctggccagggtggcccctggcccaagtccccctgatgacatcctcccgttgtattgcagtcccacctcttcgtgctgcagctagtgcaccgcccatccgtccgctcggtgctgcagggcctcctcaaaaagcgcctcctgcctgctgagcactgcatcaccaagagtgagtggctcctgcccctcagctgccaggcagccatccccattctgtgtggcccaagcccaacaatcctccttgtgggcacctcctcgtgtcacaccaggccttctccttggacaggtggctctgcagtaggggcagtggttagttccaggtggcccctcagagctgtcagtgggtcagtgactgggtccctgcctcgttggcatccccattcacacctccccatcttggggaccctttactcaagtcctttaccttgttgatgtcagtaaagcggaacttcagcagcggcaccatccctggcacccctgggcccaacggagaggacggggtggagcagacagctatcaaggtgtccctgaagtgccccatcaccttccgcaggatccagctccctgcccgaggtcatgactgtcgccacatacaggtaggtggttactgcagagtcttgccggaatttgctgctgctaaaatatct

SEQ ID NO: 15656 - DNA, 1941 bp, Homo sapiens
gtgacaggatggtcactcaggtgtggccagtcagtgaccaaagctgctaacagagttcactttgtcctcagctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacctccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcgagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagaggtgtgtcctgcctaccatctgcctgtccagcttggtgggggtccgggtcaccatttcctccagtcctgggccccatccttgagggccttcccagccagccagcaggagaggcaagaactgggggaacacaggaacctaggggaggaggggagcgctgggcatcctcaggctggcggccaaggcctgcccctggaggcactagaggagggcatctgtctgtgggagcccagaggctgcagggaggaggaggagggaggtatctggtgtgagc

SEQ ID NO: 15657 - DNA, 1292 bp, Homo sapiens
acctgtaatctcagcactttgggaggctgagaggccccggatcacccgaggtcaggagttcaagaccagcctggccaacgtggtgaaaccccatctctactaaaaatacaaaaattagctgggcgtggtggtgcacacctgtagtcccagctactcaggaggctgaggtaggagaatcacttgaacccaggacagaggtcgcagtgagccaagattacaccactgcaccccagcattggcgacaaagtgaggccatctcaaaaaaaaaaaaaaaaaaaagctatggttactcttctcaaaaaatgcacggaaagtcacacaattttacatacagttttaaagggttcacagacccctggggtgtagccattggtatagatagtttaacagtatcagaatatgaaaagggacttaagtaaatttcattttttctataattaactttttacttgaggcaaaaactttaaaagtttttaataacttttttaaatttcattctaggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgcagagtgctctactgaccaagaaagttgttgctgccacattatagatgtggagcctaagggtcacagaaattgtgtgctatgccaaaaaacattgaactggtag

SEQ ID NO: 15658 - DNA, 2840 bp, Homo sapiens
gaaaatgaaaaaataataaaatcgcatcaagaaaacttattaccttagagattcccaattgatatctgtacccctgatccaagtaaggcctttatgaatgtattttatatttcctaaagaaatagggaatatgccatcagtgtaatcacctctattcacagtcatttaatttgaaaatctaactcatgtctcttgaattagacattccaattgggataggtagagtcatgttaaaacaatagaatagcaactgccatattggtagtttcactgctcaatatgatttctaataagagcagagctttattggaagctaaaactcatttttctccatagatgattctaacagtttaataaaaaagtataattatactttaagtgtcaacagattttgagtctagaagcaaatttcattttccttgtgttatatctaatatccattgacatgggtaagaaaactaattatgtctttttagtatgatgaaatgtgggcccagagtattggaaagaaagcaatagccctattcagtgtccactaggatggatattgcagaaggcatgagtttgtccttttttcccccttaccttaaataacacttcaatagctaactttttccaaaatatccatttaggccatctcttatttcttaaagccaaatatttcgtccccagtcttaactctgagttgcaagatcaggctggttggaagaatctttatatttagaaataggatggtgagtggtttgtttattctcttgtaaaattcctttttcagagacataactgcagggagagtcccaagagaactgaagaactggattatatcattaaacacatttgtgttgtaggaatttgggagtttcattttgaactgataagatattagacataaacccttgttccagcccacatgtgtcatccctgtgtacaaaagctctctggattctttttttttttttgagacggagtttcgctcttatcgtccaggctggagtgagtgtagtggcttgatctcagctcactgcaacctttgcctcccgggctcaagcgattctcctgcctcagcctcccaagtagctgggattacaagcatgtgccaccatgcccagctaattttctgtatttttagtagagacggggtttcaccatgttggccaggctggtctcgaactcctgacctcaagtgatctgcccgcctcagcttcccaaaatgctggaattacaggcatgagccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtgaatgacaatcttgtgcttgtgtctctaagtaattatgtggtgataggggagggaaatcccatctgttggggctcacgaatgggtatggaatcaggagttcccacttaaaatgacttaagtcattgcacatttcatctgaactatagcctgttctagaacttctgggttgccgtaacccttttctagtaagcaatttgtggagtaaatcaaaactgcaaattaattttatgctttggttgataacctagacagccacttggttcccttaatttcttccatcatttacaatggcttgaaagaaactgctaagtcttcattcattgtttatcaacattgtagttgcttaggaggtaaattagggcagccttttctt

SEQ ID NO: 15659 - DNA, 1102 bp, Homo sapiens
gttggtttattcttttttctttttgtttggctgaattgcagtaactagccttgcctttctattctgtagaaatgacagggtcttcacaatccttcaccagtggctactaagctataattagctgaatagaaagaatgtggaagtggtctgaggcatatagagtatatgccaagaacactaccatatatggcatcagctttggttaccagagaaattttcttagtcattagaccatgtaacagtaatatatcatatgtaaatctttagatatcaatttgaaaatcctccaaaaaaaggagcaaagaatgcataagctatgtgttggcaaaagtaatttatattaaaattttgacctgcctatgtaagattaagtggtaatgtcatagtggtgggtttttaagtcttaaccaatctctaaggtttgtttctcctgcaagggatggttcatggcctctcttcccactgcaggaagattgcagaaggctgtggattaattgtagcatttcactgatcttcactccagtcactagggacaatagaaacctgcaaaacacagattcattcgtaaatattattaatagcttattaaaggaaatggtctttgttaattccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatgg

SEQ ID NO: 15660 - DNA, 1102 bp, Homo sapiens; identical to SEQ ID NO: 15659

SEQ ID NO: 15661 - DNA, 1099 bp, Homo sapiens
tgcttggagtagaatccgttactaaaatagtttcaaagttgacaaaaaattttcaaagataaaagcagttttacattgggggttgctgaggtaggcacaagaaaaagtcaggcataaagcacaaggcagactgtttgagtggattggttgctgctcactaaagttgttcccctgatctctaaatatggaggtcattaccaagaaatgctttggtatgaatgagagccagatctccactgtgtgagccagtgaattatggctaattcggctgttacagccactggttggctggattttaaaccataaaacttgaagattacctacaaaagtaacagtgtggctataagcctgagctttaatggatatacatcctcacagaaaagttggaaataaccaaaactgaagtcttaatttaccttcagtttaatctgtggatttgttcaaatactaaagatcctcaggtccagaattccagcatcatttattcttttaaaatttttaagaacttgatccattgtatcagtacctcacaatcagagttggcaaatgatggatgagtgattcaagcagtgcacccggtggaagctgaaatccatctgtgaatggaactgaagtgaacgtgaatatgctgactatatcctggaagcatttttataccatcttgaaatttcaacaaactggcttttgccagttaatccagctgtctttcaagaataaaagttggggttttcaaggatcgcctcttctatattttaaatggattttcagtagaaatgatttttactaatcaagttaatcccaccccatcaaaaggtattcctagaaatgtcatagacctaggtaactttgaattgaatgggagctaacgttctttccaaagttttcaggtattctttgtgtgacaccttctcaaccaggaggcaagtaaccccgcctccacaatcttagtattttttttaaactgcatgcctgccccttatttgagctgcctttttaatttattgcatatcctttttattatcttattttggtattattcaatctatacaatctttttgtatttattgggaaatgagtaatatacaaaaaggttttcatg

SEQ ID NO: 15662 - DNA, 1163 bp, Homo sapiens
aaggtaaccctatcctcttaaccctgtgcactagccctcagcccccaccagcccttggtccctgtactcttggcctcgtggctgtgaggaatgagccagtcccatcacattatgggtacacttggctcttggccataaagactattccttagtatggacattaagttgattctcgacacttgctccatgtgattttgggctgtttccaaaatttacactttcaagatatttcaaaccatgtgccgtaagtctgaatctgaaggcagttccagaagaatctcccaaatggtttgaacacattggtgtccctggaataagcactgttctgaggggaataacactgaccttattcactcagcatttgtcacatgtgtgacatcggccagcacaatattctcaggagaagcgccccatgccggttgacagctgagtctgtatttctgatgccctgtggttccttccagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacaggtacaggaggtcaggggtcaggagggtccttgtcctaaggagtacatgtgtgaattttatgaagttctggagacagtttttgcagcttcgtgttgggtgctgctgtttgtcacgaccaataattgtctttcctgtctctgagatcagccagaagagggcttgagatcagttaccagacactgggggtgactgtcacactaagagcctttggggactcaataatactgggatacagtatttaggactggtatcctgttcctctgcccggtggggctcctattgactccctctgggtacagtggagttgcccctctgcccaggtgtggtggagcctagagagagtgcagtggatagggacctcacctcagcttgactgatattttgagctctgcacagtgtcctcaaacctgggacagaaaagatgagacccagacctcccaggagctcttggtcatagaggttactctctgtgtgtccttgccgtctgctgctttcacaatgggatagaattgggc

SEQ ID NO: 15663 - DNA, 1219 bp, Homo sapiens
ttttggtgttggacccctggggccttcccaggcttggtcaccctctgcactgtcagcacttgtctgtctgctttgttgagcagggcgtggttctccagtctgccctgtgcactcccccgccacgcccagcccaagagggctgctttagggacagacctgggttgttacctgcctgtctctcccagcttcttccctccatgagtgcttattcacatatgccggcctcttgcgtaggggtctgtatcagccccagcaggcaggtggagtcctagaattctgaacctccagagcagaggagcttcccagggaagctgattggagattcagtgcatggctgggggttctgatggagctgtggctactgaaccacagccatcctgggaggctttctcccatcagttgtctcacacttagctgagtgaaaggcaccctgacagcatgtggtgacaggtgatgtgagggctgggtgagcacttgggaggcgctggctctgggagaggagaagatcccacttggctgacaccacggcaccaagagccaaactccatcgttgtcttcaccaccctgaccagagccttgtgctgtcatctaggaactggctgcccaaacaggaccctggcagcctccctgctgctgcggggattaccaggtgctgggaggcaacaagctttctaccttccagcctctccttagagacacctattggcagaacctgactaaatagcagtcagggaactgggttgcctccagccatacagaacagagagtaggacagtggggtggagctgagatggagaggcccacagccctcagcactgtaggctcccaaccctaggctgtttccccaaaaagaaaaagtctagtcactgctctgatgcttggccactcacccaagcattggggtagtttgtgctggcttcactgggcaccatcaggcacacccagcctgtagtttttgttttatattacctaagtcggccaggtgtggtgggatcacgcctgtaatcccagcacttagggaggctggggcgggcgaatcgcctgaggccaggaattcaagaccaacctggccaacattgtgaaaccctgtctctactaaaaatataaaaattagtcgggcatgatgacaggcacctgtaatcccagctactcaggaggctgaggcaggtgaatcacttgaacccgggaggtggaggctgcagtgagttaagattgtgcc

SEQ ID NO: 15664 - DNA, 1049 bp, Homo sapiens
ccacactctatccttgcccaggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctaggtgagccccctgcccctagtactactggaactgggaaactgcctggtcttgtctgcctagtgccaggtgagaatttggggcagatggaggccagggctctccctccccctcgctctccatcctctccctgtaggtggccagcagaccgtaactctgctgcctcctgacccagaaaactgggctgggactgggtgtaggggtgcactgccctctcatcagggtctccccatctctggccgtaggcccacctccctcttctttctccttgtctcctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctgggtgagggctccccctggttggcacagggcctggcattgcctgagtctaacgggactcttctaacccaccccgtctgcagcaagtactgacctagggagctgcagggtgtcagcctgggctccccacagtcccatctttgttcatctttcctgtgggggggtttctgagggatgtcccccaacatgttctcatcccacaccccttccccagatgctgaggtgctgctggacagtgacggcgagtttctgcccgtaagggactttgtggcacctcaccttgcccagccaactgggagccagtcaccacctccagggtctaagaggtaggtggccagggacctgttggccatgggggcaccatg

SEQ ID NO: 15665 - DNA, 1282 bp, Homo sapiens
gggagtgtgccctgtgggtggggaggtcagaagccccagggacacccagatgggtgagaggtccacccttcctggggagaagcagctgctggggggaatctagcacattccagagggctgtccgtgatggtctgcatggcggttaagggaggtgccgtgggaataaagggagttggggaagatgccccatggagatggcattccagccggaccttgaatgatcatcctgtagggttggctcagtgaagcagacaggagggatggacccccgaaggggaaagaggccatgagcgaggtatggggaaagggagaaggagatcaatgtgagcctggtcccagccctcaagactgtgctgaccacgcaagggtgtggcctgggcgggaaggtggtggcccaggtgcagcatgtcttgccagcgctctgtggccaccagtgtctagaggtggtggagccagcagtggcgctcacagcctctgtagcgctgtctcttaccatgtgccttgcccttccctgaaggagaaccactgtcgccgcatcaagattctcggggactgctactactgcgtgtcgggcctcacccagcccaagactgaccatgcccactgctgtgtggagatgggactcgacatgattgataccatcacgtaagtaccccgtggggctgagaggagtggcctggggcatctacacattgaaatcctagaagctgagccaccttctgccccatgtgggctcccctctcagggtctcgctttgtcctgatgggtctgtctgaggctgcagagaatgatgccagcattaggaggatgctgggttcaggaaagcatgaaaggatgcttccgtgattccctgcctttacatttcgtgtgtggctgtatttctttgtccacaggaatcctgcatattgtcaggtatgcatgagtcatacaaaaataaattagtctttagcttagccagataagacatacagaaaggtttggccccaatctagctgaattctctattaaaaggaagtaaatatgtgtgtttctcttcactcagcaaggtaactgggtctcagatgctctctgtgtggggagacaggcttgggatcggggcaggtgagtcttcatggaatgaatattacacctgtgaggccaggcctgcccatttcttggtcagtcttatgttgtcattgtccttatcagagactgggatgaagacacagatgtttttgtcaagttagggaaggtgtggagctggaaggctgagctaatgtatggagtgtagatccaaacaaac

SEQ ID NO: 15666 - DNA, 1183 bp, Homo sapiens
cccagcgggtgagtgggtgatgttcatccgattttacagatggaatttcacccagaacatgaggactgtgagggaattgaggttctgagcctcagctgggtgcactgcccagccctccccatcctccccatgcgatttctttccttgtctgtagaaggggacatactggaaactgaacggggtaacaaagaccttcattccaagccctggttgtctttcctgaccagggcctccagccttcccccgcactttgcttcaggattccgagcatcacgtaggcttttagaggcctttggtgcggattgagaatggaacgttttggacgtggccctcccaatatggttttgtttgctgctctattctgggcacgttccccaatgcctggcttgaagtaggcgctgagcaaatgaatcccagtgccctggggtggctgtgtttgtcaggatggcattcccagtccgagaggcacaatgtgtctcattcacagcatttctccttgccccttgtgtgtttggacagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaaggtaggagcagccagggagcctgccatgctggagctgccagggactgatctctgtcctgccctcccaatatggcccccgtgccatttggctagatcagaattccctgttcacatgtggataatcttgtaaatgctgctcagagctgagctactttttatttcctgcaaaagtcattatagtgtacttttttactccttggcattctttgtatttgtccataatccatgtatttattcctgtttatccataaattcaagctaaaattccccacctgctgtctaaatggcctctgagggtattcattctggacagatgtgctaggccctccctccttaggtggatttcacactaaggctggccctacccacctgtcatccttgcccccagcgtccaagcctgtgcctcatctgtctgtgcctgtgcggcttcctggctccctctctatgcaggagctcgctgcctgcagatggccttcctctgttactctcggttagcagcccagccagga

SEQ ID NO: 15667 - DNA, 1864 bp, Homo sapiens
gtgtgtgggacctgctccaggctgatccctgtccgcacaggtgggtgatgtccttggctgctgccgtcagaggcagccccctgcacagggaggggctgatcctgcctcagctgtgtggccatgtgggggcagcaggggcctgggccatagctgggggaggccagaccctgagggctttgcagggcggccagtgcagtgatgcctggcgcttccagctgagacaggagtccggacagaggtgggcagggtggatggcttcgggcagggaaggcgggtagaggctgcatgtgggggcccctgtctgcctgtccttagggtgtggattaggctctggcttctgtgatggtgcaagaggcaggatggtctccagacaccttcttgcagagtgattttgaccaatgcctttccagcaccttcccctggttatgacagggagctcccaggccaggccacatgaccccacaggtaggctgaccccatggacccactggagactttgagggcagagctcgggcacctttcatcttccttgggtggtcctcatgtcgctgtccgctcatgttcctggtgttctggcatcaccttgtgccggtgggggctgggctcccgtgaggtcctagggcagaaggaggtgcttgcagggcctctcgctgctactgggacatccacaggacctaatgtttatgtggaatctccaggctgccatcgagggctcctgagctcatcctgaggacccagggtccatctgagctggctgtgggctgagatcctggctggggccctgctgtcaacctctcctccaggccctgccttgtccctgctcctgtgctttcctctcttcaggacaaatggtttgtccttatggtcccctttccactaggattttctcatcctcatctgtctatcccagccggatttaaagcagtcacttcagacaggagccacagggagcctgtgagggagtagtgcggtggtggtgagtgtggctgccctggctcccccagctcaccgtggtgctgtccttgacccacgagctgttgagaagggtgcagagcccctggcacagccaaccctgttgcccccagtgccgctgcccagcttcggccatccaggtggtgggtagacagaggagtgaaccccaaaggtgtccatgccccagttctaagccctgtggccaggtgctgtcacacagcaaaggggactttgcaggtggaattagggttagggatctaaggatgggaggggaacttggtttatctgggtgggctcagtgaccccttggaatggctgagggaggcaggagagcctggaaagattcgaagtgtcacagagatggtgccgtcattgctggcttaaagacaaggggccaggagccaacaccagaggccactccacaaccccagcgccagtcagcaaggaagccgggtgtcgctcacacaaccagaaggagctgagtttggcaacaacccaagtgagcctgaagcagattcgccccagagcctccaggcgtgagtggagcccagtccagcgacaccttggtttggcctgtgagactgagaagagagccagccacgccatgctgtgcctggggtccacagagccgggaggtcacacatgtacatcctggaagctgcccaaggtgtggccacttgtagggcagtgagaggaagccgtcgcggggaccatgctgccttctctgggctcacgactgttctggaaaggaccccatggcagacttggcaaggtctccacttcaggggcaaacatctccatcatcagcaactccaaaccccagccacttcctgggagttcaggaactgtgtttagccataatgtcccttggggtttggtgaaaaacaacttc

SEQ ID NO: 15668 - DNA, 2552 bp, Homo sapiens
gctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaagcctccgtgagacggtatttgtgtaccctgaagtatgtttgtgtgtgtttgcacatgtgtgtatgcgtgtgcatgtgtgcacttttgtgtatgtgtctctgcaaatgtgtgcatgtg

SEQ ID NO: 15669 - DNA, 1212 bp, Homo sapiens
tgtggaggccttcatggggcggctcccctgggtgccctcatgcgggctgcagcatccaggcatgaaatgggggcttgaaaggcaggcagcgtgagctcagagagggccttagtgtacatattttggaaaatacctcctgtgctgcctggagggcctcagcacccacttccccatccctgtcttcccgtgtgggtgacgcttgctggtcttcaggtgtctctttgtaccttacatgctgtcttggtcggcttgtcttttgaacagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccaggtaggtgtgtttccagctggttggaagggcccctctgtccattcactggggaagggaagggttcagacctgcagctgagctggcatatctctagtgctgggctgggcacctggagaggaaatccagagccgttggggtacttttccattttcctcgtccaaaaccaagcactggctcaggcttttcattcactcttcttggcttctgtgtttggccaccttggattccttccagttgtagaaagtgcagacatttgcagtggttctactttccatgtcacttgggaacatggctttttgtaaataacaaattc

SEQ ID NO: 15670 - DNA, 1233 bp, Homo sapiens
tgagatactcatttacctgtaccattacaaactctgtctacttcacttattagctgtatattgtattagaaggatgggccgtaagataccttccgtttcctttactgttgaaggtgaaagtgttttccagttttccatggctaggagaggcgggctggttttgtgcagtggatccagacctcagcctccttgtcctactgtcagaggaggggtttgctcagtgggccagcctgggggagccacaaccacaactgtttggaggggccttcacttgactccctgttctcacattctactccctgtgccaatttcagacgatgacccctggctatccccaggacctcgatattatcgatggcagaattttaagtagcaaggagtccatgtgttcaactccagcatttcctgtgtctccagagacaccgtatggtaagaatgaagtaacactagctgcatgtgctgctccatgcccaaggagggtgacaacagccccttgctctgctttcttttccagtgaaaacagcgctgcgccatcctccgttcagcccacctgagcccccgctgagcagcccagccagtcagcacaaaggaggacgtggtaagaaatctacccgcgggtcacaggcgcgcggcactcaggcgctgcatcgcggggtcgccatttttacagagaagaactcgtatgcagaaatgtttccatttgtgtcgtatctcagaagccttggatgaggatggatcttgctgggaaagatgtagggatgtggccgtgaaatccactgtgtggtggcaacctggccttgcatcgctgcctggcatcctgtggggaaccctcctgtaatatgcagttgatgggaccatcagtggtgactgtcgggcagcttagcattggtgcttttgaagaaacgagaatgcccaccccacacttcacgttctctgtggggattgtgccgcacgggcgccccagctctgccaccccagctgccttctcacacgtaccttgtggcccctcctgtctgttattagtgggtgcctaatcactgtccctggatctctgcaggaactcaggggctctgtccatggcctgatcgcgtccgtctgtctgcatagctggctcaggcgagagagtgttagtgggcggtgtttagggcgagttactgtgcacttcttctgggtggacttgaggacttgcctgagagtccaggacaaggccgagctcaggcaggtggagagaga

SEQ ID NO: 15671 - DNA, 1203 bp, Homo sapiens
ttccctctccagaatttctcattgctaagattcaaattatcatagtcgggccatgctctgcccaaggtcaccgcaggtgtgtggtcctcagggcactctggtcctgacaggacaccaggggtggcatgtgggggcctccttcccagctgggtcatcgtcagtcccacccagcattccatccgggcactgtcctttcccagcactgagagtgagtctgggtgcttggtcctatctccaagtggcctgttctggaaggagcatgctggcctggggaagctgcacatttccaaggctgtggccttgttcatccctgagagtctgagaatgccctgggtttcccatcagctgccttcagcaaccacagcatcttcccagagcagtggtgaccaggatgcagcatacagcacctttgagaagcagcaggcaagatttaaggaaggggcgcctcactccgccttgaggaagcgccctgcagcctgcttgtctcccttttaacaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagaggtatgtgccacagccaggtcccagtttctgggcccattccactccctttcttgtcctggaaccccgagtgaatgggcaatgaccaggccttgtccctgaatacagcccacattatcctccgcacccaccttccgtcctggtttcacaaatatggtcgtggctcctctgtacctggcaagcggtgtggctgggagagcacagtgtgcagtcagctggcctgggtaatgcaccccagagatagctatgctggtgaggccacctcactcagggcactcgagcctctatgttctaatctgtagaatgggcacaaggagcacagcatgtgggtgggttgtgtgggttcgaggtagggctcttataggcctggccttagccattctccatagcccgacagcagcagccagtggcacacacagccttccttcagggtcatcacactcacacagggtcctcagtcctccctccgagacctccctaggaggtgacccacagatgagggccacagatgagagcttcttgctcttccaagaggcct

SEQ ID NO: 15672 - DNA, 2117 bp, Homo sapiens
tcttcttgtctaagatgaacagtccattcttggggatttatgatccaagccgagctcaatgttcacaatcatgatgaaattaaccatgagccctaaaggcaagatgattcaaaaggtgaagaatcccagagttcaaaatgacaatttgttttgcatggaaaggtagaagtgattctagcacctgaagatgtttatttgaatgccttttcattggcatcctccagagtatatatagaactttgtgatgttagaggaatctttgtccttgtttattgtaagtcatattttgaatccatttatttgtttagacagatgcacacgcccattcagagggtgtgaggctcactttcatccctgactgaaagcctctctccggttttctcccccgcagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggtgagctgggtctccatgggaggtgctccacgggaggtgctccacgggaggctaatgtgtgatgagaaatcagcctagtaggttagcttttggcgaaatccacaagggagggacatttcccttgcagtttcaactcttgtgaattttggcctaggatccaaatgctgtcatgctggtgtggtcccttggtaggagatttggaggatgggaagaaccaggcagaagacttgctgttaacgtcagtgcaggggcagggacagcatgctctctgctggaaagggccggtcatgcctccattgcagaatgggcttaacagtgaaaccattcttccttcgtgaatgttggtggatttacaaagaaagcatacttacttctgtccctgcggtataggtcagggctttgtggaagaatgccaggtacttcagtggggctgaaggttggggatgaagaagactactgagccctcaga

SEQ ID NO: 15673 - DNA, 1238 bp, Homo sapiens
aaagaaaccagtccctttatcatcaaggtgaattgtccagatccatcaccaagatccacatgcatgggagttttgtttccctttttaatagctgtggaaataatcatgctttttctatgttcattgtcatagatttaggcaaaaacctttaaatacatggcttgtgtgttaaaaatccccttggtattcctaaaaagacttgaagggaggagtgtggatctgagagcctggagcctggattcaaatctgtggactctgaggctcagagacagcttaccgggcctctgtgtcctcatcagtgaggtggtctgaagactcgttttgcagaagtgtccaagcctggttcacagtggacgaaagatcagtgcttacttatcccttccccctcgtggctttaactatggttctagttgtggaaaatcctccacagtctctgattagtgttgtggctcctggcaggagggtggaggatggagaggcttctctctcctgctcaagtcaggctgctcacctgtccttatggtggagtcggttggatggaggtgatgggtttcactgggactaatgttgctgcctgtgctctgtgcagggtccgaacacttgtacaacgaccacggtgtgattgtggactacaacacaacagacccactgatacgctgggactcgtacgagaacctcagtgcagatggagaaggtgcgtgtgttcatcttgtgtgcagttatggaggcaaagggcacagggaagacagcccactcaaatatctgaagtattttgcagtctgctaagaagaaaaaatttcccctgttttctcagaggtccagaatcacaccttcgtgtgacacagttgtgagttttgagggtcttcgtgagaataaggcatggtgagtttgggtcagggctttttgtgaagctgtaacgggtggatgagctgtcagtgaagttatatccaggagctccttggcctgaacttgtgtgtatgtataatgccagggaccgttcccccttcttccgtcccttccgttttgcatatggggatgccaagcgctggccacagccaaactagctactgttgtacggccccacatgcaacagacatcttgttttaatttctgtttgcttgttagtctagtgttcctgatttatggctgtatcatttaaatctctgttttcgtgaaaccgtctcacccaaacatgtcctctgttcacctgtgtaatatgcacattgggtcatagctag

SEQ ID NO: 15674 - DNA, 1153 bp, Homo sapiens
cggcctccgcggagtgtgttccttgccgggaacgtgtgtcccccgctgcagctactttgttttgttttgtctctctaacccaggtgaaatgctaccacaagaaataccgctcggccacccgtgacgtcattttccgcctgcagtttcacactggggctgtgcagggctacgggctggtgtttgggaaggaggatctggacaatgccagcaaaggtgaggcgcggagctggcggccctgtgcttgtgggcagctgcggttgaacctccttggttgattctttcactatcccctttaccctctttccaaaattcagcctactgacaaaattgttcccaaagtaggagaaaatgatcattgatccctgggggaaaaaaattatggataaccaatgaaactgcctatactttctgtatcatggggtgtctttattgcagatttgggagtggtgctgtactggttggaataaaggacaaagtcagtccatacttttccggttaattgtctccacaaatgtgttaaaatacattgtttttttcagatgaccgttttcctgactatgggaaggttgaattagtcttctctgccacgcctgagaagattcaaggtgggtagcttggtggaatactgggtggtccttgctgacactggtgaaaggtgcatgatggctacgctggggctgtagtactagtctcctgcctttgtgcatatttggagatttctgtgattaattttatttaaatgtaggatattggatagtggaacaagaaggcccacttgtgtcagtaagccccagaagtggcgtgacttgctcacaaccactcagccaggagagccttgggcatgactggccattcttgtaggagtaaggtggtattgcattgtggttttaatttgcatttctctgggggttagtgatgtttagcattttttcatgtgtttgttggccatttgtatatcttttgaaaaatgtctgttcatatcatttgcccactttttgatgggattatttgttttttttttttgaggatttgttcgagttccttgaagattttggatattagctctttgtcagatgcatagtttgcaaatattctgtctcactctgtgggttctgtttactctgatgattatttcttttgtggtacagaagat

SEQ ID NO: 15675 - DNA, 1172 bp, Homo sapiens
gagtcactgtgtctttagcacatggtggtgattttctttgtccaagcaccaaacttaattagagttttgaaggtgcttcctccttaagtgctgcctttccaggagattgtctctgaggtgttgtccgcacggtgtgggagatggctggctgcactctccaaactgggattttaacccgagtggggagattttggcagcagcttgggcctaggactcctgtttgtgatctcactggactgcagccccgtccacacaacctgcaccatcagcaactcaaagacctttctagaattgtcaccccagctgcagaagagcagatgagcccctggaagaagaggcatcacatgggcagtataatgctttattttttcttcccagtgaaggaagttgatcctcatgctcactgagttttaggaaagggtcacccagcatgttctttactcccaaatgaaatgtactgatgatgaaagaagtcattgtgagatggcctcagaaggttttaggaaatggaaaccgaggaagctcccctttcttgttgcagatcatggatgtgggctggccagagctccacgcaccgcccctggataagatgtgtaccatatgcaaggcgcaggagtcctggctgaacagcaacctccagcatgtggtcgtcattcactgcagggtgagtgcgccccctctcacatttgggggtctggctgggcttcagcctttggagttgagatggagaccaatgctgcatctgagcacatttccgctttgagctggtgcgatgtgctccttatgggtttgtctttaggttttcctacttgctcttaaagaaggaaacagagttatcacacctccccaagtttggctttagaatttataggattgtggtccctgaatgtgtagctggacatttgaaactgttgaccccaaattgaccacgattatgagagcaaatcgtttcatttttattaaattttatttttcatggaaagccctccttttcaaaagagctatgtatgcccttttcagatggactgtgtcagactttccatgccatcttgagttatggtaatcagttgatggactagatgatggcatgatgccattgcagtaaacgtgttgtcctttccacgtggagccattgcagtgcagacatggcctgtacatcttcacagagtggc

SEQ ID NO: 15676 - DNA, 1253 bp, Homo sapiens
gctctctggggtgtcagtgcccctgcaggcccctctgtgacctgcccttagacctggctgctcttctgctctgtcctgtgctggcggcccctcccacacctggagtttacctggcacttgtacccacccccaggccctcctctgctctgcagctaacctgaggggcatgacccctttggagaggttctagaatagcttcatcccagcatgttttatcgaggtgagctgccgggtctgtcaaaattcctggagttgtgctggctgagggcatgattgttttgaaacccctgggcctaattccctggtagggcagaaagaaggcagtgatgagccttgccagccatacttaccgacatcccaggacaggactgtaagggtgtctgtcatcttaatgacatactgtgtgagggttctttgtctgcaggcatagggtgcctttgtggctccccggggcatttaagacacaatggagaaggaaccttttccgtgattgtggcgcattgaacccgtggctatttacctgtgatgttcgttttcatattcctggtagcagaatcttctgtttactgcagcagcttacaaaagtgggatgtgaggttagattaattcatggactcaaaatcggcacatagtattgttgagaaaggagctgggaggcaaacctccctttgtgaatgtcaacttggcatatgttacatggacacagggttggagcttcctgggagccagtgtgaaaaggaaaccacaatgattggcatgtgcctttctggaaggtgggaagaaacaagaatcagcagagaaaatgtgcgacgtgggaaattatggagggtgtagactaaggcatcaggggcatgcaccacgtctccatgagtcgagcagaatgatgattttggagggatgtcagaggcaagctattgcagcatagcctcattgggacctctggcttttagaactataaagggacaattggtgtctttctgcttacattaccgttctatgggctgtggtcttctgggtcatagagagaatgcttcaccattgttcaggtaactactgtccctaaggctgggagaggtggccgggctccttacaggggagtcacagcctgtggtccagctgctctgtaagtctacgtgtatgtgtacacgcagtgctcacatgcgcacacaggcacagaatgtagtggtaggtgtgagcatggactagagttgggttgagtcccatccggggtatgacactggtgagctgtgtgg

SEQ ID NO: 15677 - DNA, 1227 bp, Homo sapiens
ctgactgttcttcatctttgtagttatacattgatatctgtgcattgaatatgtaggtatttataaacagtctttgcaatctggctttgtctgtgattgtccttgtatagtaggtctgtccagaaattgtaagcatactgtcttttttggtctttaagcccgtgaacgctacagcccgtgtagtgccaaatggtgccctaagcccaggttccctgcagtccactctgtgatttgtttgttgactgctgtgagccccacccccattctttgtttctaatttacacctagcaggctaaccctgctggcacctgcagtgcttccagggggaaaggaccatagtgtgcccctgtgaagagtctcagaatggtgcggaaggtgaatgcccacctcccgctctcttttcccactgtagaaactgattccagagaaattctccaagtgcggtgctatgtgggcttgcgggagaggtgttatgatcaaacagaaccattctctttaccctctgttcatggtttttcttggctctgtggtccagtgagttgtcacagcttcactcccaatttctgggatattcagggcaataatcttgccactgggtatttgctagttgaaattatgtggtagggagagaagccagtaagcttcacttctccgtttggctgatgtcactctcgaattctgtactttcatacggattgtaatagggagggtctaaaaggaagcttcagttttggatttttagagcttcttctaagtacaattgttgaatcaagaggtaaaaatggtatgttataactggaaatacgctgagattaaaaaggagataaattagccccattgggacagtgctattgggaatgtgaattgataccactttcctggagtctagtttagtatttattttatatgtaatgcctgaaaagatgtgtgtctcctttgactcaatacttataggaatttacacaaaggttataatcaaagattatagaactgttatactggaaaaacacgaaatattctaattatgaattaattggggattggttaaataaactatggtttgatatgctctaaaaataatgttacagaaaaaagtgtactgatatggcaaaatgtatgacttatagttaaaaaagcaggttagatgttgatagatacagtatgatagaaaaagatcaggaaggtatatgctgacatttaaatctggatatttatgagtgttttttt

SEQ ID NO: 15678 - DNA, 1748 bp, Homo sapiens
gcctatgtttaataatgttgaaataggatggaatattttgttaaattaacattttaaaattagaagacaccgttttaatttttaaacccttcctcctctcattgtaacgaaattaattccagctgcagtgagaaaacttaaaaatcatgatacaaaatgaaacaatatctgaaagtagttttataaaactgaaattgctgttaaagagaatgtgttagtgacttaaccatttgctctatgtgatgtttattatcaaatacatataattttgaagattttaatgaatggcttaagattttatctttgtgtagaatgtggctaaagaaaccttagttgagattcaagaagttggtgtctgtttctgattcttatcacaacttgctacttagtgtctaccaagtcctccacctctttgctcctcaaagagctgtgaaaaatgatggcaggagccggtacaacaccacagacttagagaagggcacagtgctgctttattgaatgatctaccaaggtaaaattttgccgggtcaagaaatagcaatttaatccatttaaaggaatgaatataatttgaaacattaacttatttcaagactaacatctcaaagtgttgagaccttttttaaaagagctttctggattttgagcatactttcactggctgtgatttataagaatttgtggtttgtggagtactgtcctaaatgccagggtaaaataaggcagtcccatgccttacctgccctgggctcagggcctcacatccttttggtacgcacatcttttctcttctcccttgttctgctctcccgcagcatatacctcctagccccaggcaattacttgtctaatatctatctctatatatttgcctattctggcttttagctttttttttttttttcctgagggagacagggtctggctttgtcccccatgctggagtgcagtggtacagtcatggctcactgcagtctcaaactcctgggcttaagcagtcctcctgcctcaccctcccaagtagctggaactacaggtgtgtgccactgcgcccagctaatttttatattgttttgtagatatgaggttttgtacgttgcccaggactcctgggcttaagcagtctgcccgcctcagcctcccaaagtgcttggatcacagctgtgagccaccacacccagcaattctttttatccaagaattttatcacctgagttttgaggtcattctgtgccatatcagagacacttaagaatttcccattccagttgctcctggctagcatccaagtggccctgccatcctcctccagcccttccttggcccagcagggaactgcttggccatcaggtctgtaggctgagtttatagtgaggtactgtgcctggtgtgaaggagcccactcttggggacctagaatgtggcctcaacagtagtcctggggttgggattctggttcagccactaggcaaaggtatttaatgacattcatgttcttagtgtatgttgccaatttagcaaagcatccatcgttttgaagaaataacaattcagaactttttaaaacagctgtattgagatataattcacatatcacacaattcaaccatttaaaatagactgtctagtggtttttagtatgttctcagagttgtacaaccatcaccactatcaattttagaacattttcatcacccagtaaagaaacttcttaaccataagtaatcatttttcatttttctcttctc

SEQ ID NO: 15679 - DNA, 1271 bp, Homo sapiens
gggtccaccccgtgcctacctctcccacgtcccggcgacggagcgcgcggggctctgggcggggagcccaccgggccgaggcgcagcgagggtgaagccagagccggcagggtcaggtcccgcagggcgcaggcgggcgcttctcgcagcccaaacccgggcggggagtgcgggaacccctagaactatgctgggagccccagataagaggaaggagatggtgacttaagtgacgaagtgatgttttgtccccaccgccttttaaagggagaagggggtaaaatttcatttggaggatgattgttacgcgagctttcagagttcagatggcgtcaagtggccatcgagtcaacatttaacaaaatgttaccgcataaaatattgtcatcgagttatctggcagctccgcagagaaacttcacaggcatatgcgttatatgacataatttgcatggggaagggggtcccttcacgattcttttatatggcaacctgttcttggacctggcagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacggtcagtttcaaagaaacacagtctgggatccggagtagaaagaggccgtttcccgtgaaggccatagaggcagtttccaggcgcctgggtgacctgtctctgcacttccctctctgcttctccatccctgtttcctttccccactgtcccctgcctggcctttctttggctcattttctgccttcctggggtcttctggttaaaaagaccattggttccattcattggctgtaaccgcgggtctttaaaaaactttgtgacttccttgaatagaaagaatgtcttactctggatttctacaagcgctgctgagccattcccagggcaggcctttgtctctcccgcctttcagtttgtttgcccatctgcattttggcccaagctttccccatttctcagctgctcttacattatttcttttttcagaggctaccctgaccttctagtcctctgcattaaacctcatcaccgcagaccgttttaattcagcacaggtgtatcgagcacaaattatattcttggttccaatactttcagcactggtgggcattcatgtttcatttaagaaggataaattagtgtt

SEQ ID NO: 15680 - DNA, 1099 bp, Homo sapiens
cacaatgcctggctaatttttgtatttttagtagagatggggtctcaccatgttggccaggctggtcttgaactcctgacctcaggtgatctgctcgtcttggcctcccaaagtgcttgggattacaggcgtgggccactgcacccagccctctactttgttttttgtgcctttctcttccatagtgtccataatgatcatgcattaattactttcatagcttaaaaaaaagttgaatgggaaaaatgggtcactgtgtatttgagaacagtactggatgcttcgtgtttggatgtgtgggtggatctgcttctttcttccatatgctctgctgtgtgctccctggctgccctgctttaattttattttgttttacaccctgcatatcttgatgtctgcttttttcctcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaaggtgaggcagcggatacgaggaggcatctttcagccagggaaccctggtccgtcccctgagcctgccttctcgctgtggactggcgtttccacttgccaggctgctgtctcagttacacttcgcccagagtggttataatgacccgtttgagtggtcattataggcaggacctggatgggtcttgcttgtccctgtgtccttctgggcatcagtggcgctgatgtgttgtaggagcttctcacatgcatgtggttctcatgtctccatgtgtgcctcagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaaggtaagcggcacttgatgggcctcggcgtcccctcctcccttcacttctgctct

SEQ ID NO: 15681 - DNA, 1297 bp, Homo sapiens
tcacaccctgacaaaatgcaggattctcagtgaccttgtgcaggaaaaatgacaaaaaagcttttgctgccccatgaggctgccaccaggtctataaaaaactcggctttcaaagcgctttggctttctgaattgtggttcatctaccctcaaggtactagccacccttgaaggccagctcacagctctgcagaattcccttatcacctcggccaaaacgtgcctttcaaggtggtgcttgcagccctgagctggtcctggaatggtgaattccttttggaagcaggcacgagaataagggagggacagggcagggtggtgtcagagagggaggagtcttccgagcccctggaccagcgcctttccctcccgcactccatcctccggccccgcctgactgcatgggcagcctggtttcctgaggaggcagagaggctgctcctcagagctcgtgggttcttcatcccgtccctgtgaaatgttagacccccggcaccttgccttgatgtggtctttgtcctttgcagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgcaccacttgcaatgagagatgactgaaaaccaatgaagcagacagcaggggtgtttgagaaataatgcgtacctaaacaggcatatacacagtttccaaattatagtcacacacattcccaaaaccatccacaccagcttaatcacacgacagtaatcctcccacccattgtccacaatgctagtgtcttgatccaagtacctagggatgggaaacgggacacctgggctcaagacagcttgtcctattgtttctg

SEQ ID NO: 15682 - DNA, 1379 bp, Homo sapiens
gatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaa

SEQ ID NO: 15683 - DNA, 1110 bp, Homo sapiens
ctgtaatcccagcattttgggaggccgaggaggccagatcacttgaggtcaggagttcgagaacagcctgaccaacatggtgaaacctcgtctctactacaaatacaaaaattagtcaggagtggtggcacatgcttgtaatcccagctactcgggaggctgaggcaggagaaccacattgaacctgggaggcggaggttgcagtgagctgagattgtgctactgcgctccagcctgggcgacagagcaagactctgtctcaaaaaaaaaggctacgtttgagtatttttagtatatctacagaattgtgcagccatcaccacaatctaattctagaacattttcatccccctaaaagaaaccccacacccagtcatgccactttccccatcctcagggctactaatctgttttctgtctctgtaggtttgtctattctggacatttgtataaatgaaaacatacaacatattgccttttatgactgttttcttcacttagcataatgtcgtcaaggttatggcttttattttatttgcataatttgtagatgccaccaaacccatctgtgtactggtttctgtccattcttctctcatgccatatagtgagtcctctcatgaaggaagtccaaggcatttttcagctgacaaatgtttccttttgtaaaactttgcttgtgcctccagtctgcaaatccagtttctggaggaagcgcgttagtcaaacactgtggctcacttttctgcctccatatctgccatcttggcctcactctctcctggtctaatcctctctaatctgaatttcaggtcctctcatgctgaatgcttcagtgtgtcatgtggctctttactaaagcagaagtgatgttgctatggcatcacggtccctctccctccatcctcattatggccagaacttgcttggtctccatctgtgtgcactcagcctactttgttcattgtaattgtcccacctctgctaggcttcttgcctctacttcatggaagtactgccctatccagtctgtttgaaaatggcaagcacatttttcctaaataatttgcttccattttctgtgctctatactttgcagatgtttgctct

SEQ ID NO: 15684 - DNA, 2604 bp, Homo sapiens
gttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttg

SEQ ID NO: 15685 - DNA, 1132 bp, Homo sapiens
atcaggcttcatctccactttccagcttagccttcatctcttttgcctttgctgtcagttacttcttgaccactggcttttatgccttttcaaagattctgttcttgttctagtaaagcaaaatgtgtgtcctgtcagccattcagtgaaggtctggcttttcaagattccttgtccatcattagatcatttctctcttgctcttcccacatccaggaacagctgcttcgaactgggacctctggcattttgtaatagaggggagtgtggcagggaagccctctgtcctgcacaacctgttgttctagcccaggagatggcagggtgcgtgggatgttcaggcaaaggagttcaccatccaggctgggagctgctgggcagggaggcagaggaacactcgagccacctttgtggggttgactgcagaggtggaagaagccactgtgtcagaccgcagaaaagtctcatatctggagtctggaaggaaagccaagttctcccagtcagtaacctgctctggactttggataagttacataatttctccacactttggtttctccccgaatctcagggtttgattctgtgcttccatttcccattctgtgccttgcgatgttcactatgtgacatcttctctgaggggtgcgcagttagagtcaaaagcgctaacaccttcaatgtttcttgcagtagccaggccatatgtggtcagcccggactgtgagaaaagaaagccttgtgttaccctttgtgttgtgttgaaaactgctcttggctgctttcagaaccagccttaactctgcttttgtttgatcgacttaaacatattggaattttgtggtcatgaccaccgtggaacctctccttttggagtgcatatctgcactttttccagcctcctcctccagtgaccttcaggggcctgacctggcctccgagcagttggactagggtagcttttccactctttgaaccccagactgagatggggttttcccagcgccctgccccttaacgtgtgtgaatgcagtataggatctcagtttcagaatccattgtccactgttgactgttaggttcttactgctgtctacaatgtctagcttttcctaccatgttctctgctaga

SEQ ID NO: 15686 - DNA, 1490 bp, Homo sapiens
gtctggaccaggaccccagggcccacctcccagttcccttgacctcgggcctctgcatcctgctagtcgtccttccctggcagcttttacgaggaagctggagcgtgagaaggtctgtgaggacagccctgatcacagcctcctttctgcaggtcaaaggaactgggaagggggttccaggagtactattgcaagagtggctgtgcacagagctctctagcaccagaagatctgcatcctgggcttattgacataccaaataactgtgaatctctcttccctgcaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcg

SEQ ID NO: 15687 - DNA, 1137 bp, Homo sapiens
agacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggcc

SEQ ID NO: 15688 - DNA, 1176 bp, Homo sapiens
taaatacgtgtgtgtagtgtgtatacataaatacatgtaggtctgtgtacacactgtatatgtttcatatatgtgtgtatatagtacatatatacagtatatatgtatttatatatatatatatctatgtacatatatagatattcctgtatttatgtggatattttgactccttaaaactttgatgtcatgtttttggagggtttttctttaaattattcatactgcttccaaacttttttttttagaaaatgcatataagtgccatgtgttcacatctggccagaacccttggaagacagtaaagtatatgtgttggattttaaatgtagagtcttccctgatgtttatttcgctgtgttgttagcagcttgttcactagcaagagattctaaaccagatttattattctagacatttgtttttcaatattcattatgctgttttcccccattactcactcaatttgtggaagaaggattcaggctacacacaatcctgccacacccaattgtcaaattgacacaagagttgaaggcttgtgggaggatatcttactgaattctttttgcctgtgtgttcttccagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagaggtgaggccccgctgcgtctcacgcacctgcccataatcacacggatgcgcggcgtgtacatgtcccctgttggctctccccagcactctcagtagcgccagggagagatgggtacatgaagttccaggcaagtcaagttgaagtaggcaaaaaagaaatctggcctgttttcattcctctggattgagctgtgcctcctttctcccagccctgaacatgtcctttatcctttgtctccctgcaaacttccacgacataagtaaaaggggaaaaggtgaggtgagattagagcttatgctctgaagtaactactccaaaccatctataatactttcttgtgggttggtggctcacacttg

SEQ ID NO: 15689 - DNA, 1208 bp, Homo sapiens
agaggggaacaacaacaaacactggagtctctcagaggatggagggtgggaggagggaaaggatcagaaaaaataactaatgggtactaggattaatacctggttgataaaataagctgtacaacaagcccccatgacacaagtttagctgtgtaacaaacctgcacatgtacccctgaacttaaaagttaaatcaaaaagatacattatatttctgaataactgaaaatttagtgtcttgtatgcatgaaaaatatttgtgctaacagaccttagatgatccaactcaacatacccttggatttaactaaaaatataactattttccaagctattaattatgatttttctctttcaatagtgttgtttgttagtgctgaaaatgttaacatattgctctacaaccatgcagaaggaattaatgagcttctgttgtcttttttcataagcatatctaatttgctcattcatccacttgttcatttgttctacccttatttagccaggcaaaagagagagtgcagtcattcctaataatcatgatttgttttccttttttcagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgaggttagtaggtacctacatggaaatacctgtgtctgaatgtgtggcaggtcctgagtaggggccagtgtggctcttcttatcaaagtacagtgcagagagctgtggctgaggctgctactttcatgccaggcaaagctaggcactaaacagagtttgttttaggagacaaaatgtacacaattgaataatgtttattgttgtaacattgcttctttatatattatagaagaggaattgatctacagtggagctatccattagaccttcattcaaagaggggcatggtctttaattctgtactttcttatatgatagccactggctgcatgcagcttttttaaaaatttggtatgtttattataacttaaatatctaaaatattcatgtagatttttcttttttcattttaattgacacagcttttgaacacttgaa

SEQ ID NO: 15690 - DNA, 1293 bp, Homo sapiens
ggattaaaaggtgcaaaaagacaactaaaatacccatttggaccaaaagccaccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacatacagattctctgtagtgtttgcatgtttcttggtgtttgttgtctccaggtgtaagctgttttaaatggaaggcccttctattcctgagggctcagagctgaccatgcatgaatgtatggcagtgtccacttttctgtataaaatgtataaagtggggtttcttccatattgacaaatgagggaacaggtggtgtctatcttgtatatcagaaagattatctagggtctatcctagtgataatacattgtcagccttttctgtggcaccttccagatgagaatgagggagcgaccactccaaggacggacaggaccagcagttctgcaggggcgtgctggggtggtttgggagtgcacagctgaacgcttcccgtttggattttacactcaccttcgtgttttaaagaagcctcagagtgcattgcagctctgtcagggccccattcccagcagaggcttcaggtgctttgtgtagagtccagggcagctggagctttgttggggagacttctggacccaaagggagctttcccaagaagcctttgatggccacactgtaggcagcagtgactaagcactggcagttccagaacatttacccaggtatatgttactaaaacaggctccacctcagtttatcaacattataagttactgttctaagaaaagtaaatacagttccagatgggttattgcagattaacagaaagacactcaactggactcatgtccctgcaattaaacttacttcaaccttttggaaagttatcaaaatctaaatttggaatgaatgcatttcctattttttgtctacttttgggtgataaaaagtactagcccttatttatagatatgagaaacataatgttctaaccaacaacattatggtatttgtgtgacttttatttgaaaaaatgtgagcagtaatttgggttagcctaccttcattaattctatcacatagatttcagtttttagaagggtttctgtcatcatggaagaggtggtctgggactaggtacttctcgtcttgtgagctaaggcttgtgtcatgaaagacaagaggcctctcttaacagc

SEQ ID NO: 15691 - DNA, 1194 bp, Homo sapiens
caaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccacatatcacgtttggattttcttttttaatttgttctgagattgacaaacattgctgtgaatgaccttgtcactcttgcaaaatagcttgtcacaaaagattgaaggaagtgaggaagtcagctggcttctggggaaaatccctccataggaacaaattacgaggccctgggcaaggtcatgcctggtatgtgctgagggcagcagaagccagtggcagaagcagacatgagggagagtgtggtgggacacgagctcagaggtcacagggctggatcccttgagtgttggaggccattagaaagaccctagtggccgggcccagtggctcacaccagtaattccaacactttgggaggccgaggccagaggatcccttgaacgcaggagtttgagaccagcctgggcaacatga

SEQ ID NO: 15692 - DNA, 1106 bp, Homo sapiens
gagaagcttcgtattttaggcgagttacttttttgtgaaactttgtttcccactgtaaggacaataatgctcaaattggtttgggggagctataggaaacagtctctgaagatgcataaggggcaggattggagctcagtgaactgttaaatcttaggactaatccagtttcagaagctgctttcttaatgtttccctgctttctgtaacttttttttttcttaatagagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaaggtgagaatgaaaactcaatgtataaactaaatagtacgtatcatcctttttacttttaaggtgaaagatgttgaaattaatttttatttttgttacagggaattgaccccttttccttagatgctctttcaaaagaaggcatagttgctctgcgcagagctaaaaggagaaatatggagaggtatccgagtaatttgacttttactcattttgcaagtgaattgggattatttctttttccttatactttatttttgggtttttcaactgtatagttaattggcattaactatattcacattgtgcaccccgtcagcactgtccatctctaggacttttttcatcatcacaaactgaaactgtatacccattaaatagttactccccatttctccctcccccttgccccttgtaaacattattttactttttgtttctgaattcaatatacttttttccaaagagctccccacaataaaaagctttttttaaaaattttttattattattttttgagacagtcttgctctttcgtgcagtggcatgatcttggttcattgcgactaccacttcctgggttcataggattctcagcctcccgagtagttgggattacgggtgtctgccaccatgcccactgaattgctttgtgtttttttagtagagatggggttttgccatgttagctaggctggtctcaaactcctggcctcaagtg

SEQ ID NO: 15693 - DNA, 1099 bp, Homo sapiens
ttctacactgcaggattggcagactacatggtttatggaagttgaagtagcaataagattgctgtatatggccgggcgcggtggctcatgcctgtaatcccagcactttgggagcccgaggcaggcggatcacgaggtcaggagatggagaccatcctggctaacacggtgaaaccctgtctctactaaaaaaatacaaaaaattagccgggcgtggtagcgagtgcctgtagtcccagctactccgtagactgaggcagaggaaaggcgtgaacccgggaggtggagcttgcagtgagccgagatcgcgccactgcactcagacagagcgagactccatctcaaaaaaaaaaaaaaaaaaaaaaaaaaattgctgtatatgttggcagaagctcttctagtatctcacggtgttccatttgcaggtgatgtttcaaaagccagtgctttgcaggatatgatgagaattctggtaacatcaagagtcagttcctatcagcatacatctgtgacgttggagttcttcaaaaatgttgttagatatgaaaagtttttcacagttgaacctcagcacattccacgtgtactaatggctttcttagatcacagaagtctgcggcattccagtgcaaaagttcggagcaggatggcttacctgttttctagatttgtcaaatctctcaataagcaaatgaatcctctcactgaggatattttgaatagaatacaagatttattagagctttctccacctgagaatggccaccagtctttactgggcagcgatgatcaactttttatttatgagacagctggagtgctgactgttaatagtgaatacctggcagaaaggaaacaagccttggtgaggaatctgttgactccactaatggagaagtttaaaattctgttagaatagttgatgctggcacaagatgaagataggcaagcctctctagcagactgtctcaaccatgctgttggatttgcaagtccaaccagtaaagctttcagcaacaagcagactataaaacaatgtggctgttctgaagtttgtctggactgtttacagacattcctgccagccctcagttgtccc

SEQ ID NO: 15694 - DNA, 1216 bp, Homo sapiens
ccctacaagtgtgaagaatgtggcaaagcttttagccaagtgtcaactcttactatacataaaagaattcatactggagagaaaccctacaagtgtgaagaatgtggcaaagcttttaaccaagtgtcaactcttactatacataaaagaattcatactggagagaaaccttacaaatgtgaggaatgtggcaaaactttcagtcgatgctcaaaacttactacacataagaaaattcatacaggagagaaaccttacaaatgtgaaaaatgtgctaaagcttttagccagtcttcaaccctttctacatataagataattcacactggagagaaatgctacaaatgtgaagaatgtggcaaagtttttaaccgatcttcaaaccttacagaccataaaaaaattcatacaggagagaaatcctacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaacttatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgacaacaccttcaaacttttctaaacataaaataaatcatactggtgagaaatcttaaaaatatgaagaatggtacaaagcctttaaatggttgtcacacttgattgtaggtaagataatttatactggaggaaactcccagaagtgtgaagaatgtggcaaaacttttaatttttcacaccttatagcacaggaaagcacttcagaaaaattgtacaaatataaatgtggaaaagccattaatatctgcttacatcttactcaacattagagagttagtgcttaataaaagcattataaaagcaattagtgtaaaatcagaaaatgaaagttttttttttttttttaga

SEQ ID NO: 15695 - DNA, 4110 bp, Homo sapiens
agctttttagaaatttagaatatcagactgttccagatcttctgaaaaaataatctgcattaacgagatctgaagtttatcatacacattaaaacttgcgaggtaccttttaactcaacatgtctttttcatctcaaaaatacacacaactcattctgtatgatgcagatatagcatttaaaaatagacatgttggcgtttatgccctaatttatactttattatccagaaaagtaccatatatacacagatgttgtggatcttcttataccactttcttttctcagggttagataatacattagaaaatatttctgtgttaaaaattcttttatggatagtttcattcactcctataagtcagaaccagttttctttactgttttattttaccttgaaatttaaaattatgcccatggccacttggtaaatgtatgtgattttgtgtatgtgtgtgtttttgtgtttttcagggaccattgacatttatggatgtggccatagaattctctttggaggagtggcaatgcctggacactgcacagcagaatttatataggcatgtgatgtgagagaactacagaaacctggttttcttgggtgaaggtaacttcaatacacattttctaatataccctaaaggttttaattctcttttttgtagaatgtttttggtgatttatgctttgcataaattgagtttcagatccctgttttcaaaaaaatcttttagatttgtcattgtagaaaatagtttattcaagatgtttcatctttaccataactttccacattcctgagatgatctttatcattcagtcttgattagtggtaattttagaaatttattggcataaaatattgttgcccacaccttaaaatctaactcccaacaacaattgttttgattcagtagtaccaggtagtgaaattaagaaactacaaatttaaaatattttctaaatctttagaaatttttgttataaattagcatttggggattaatttactagaatattctattgcattctctttactgagcacattaccaagttggtaattggagaatatgtgcaagatttatgttatttattttcaataaaacaggtattgctgtctctaagccagacctgattacctgtctggagcaaggaaaagagccctggaatatgaagagacatgagatggtagctaaacatttaggtaagtgagagtgaatacacagatggcacagagaagaggtcaaaggccaaggagaaggccacagcttaaaatgtgatttggtaagctgtgttccaaaggaaatagtttctggaaagcccgagtttttttttatttttctctcacatagaacatattttgtattgtttttcaattctctaaggattcctctttccctttagtgatctgtcttcaatttcacagtgaaagccaacatcctcttcatgggatataaaagactgcacaatctgactggtttttttttgttgttgttttgggggacacacaaatatgcataattttgagaaactctatgttaaacagttttttaaattctctttttgcatcaagtctgaaatgtgtgagtagtgatttctgttccattggtttttttgttgttgtttatttttctgtatattccattctgtttttactactatagctttgaaatatagttacatatgtaaggcatatgcagtgccaatataccttttcaggatttggctattttggattggctttttctttttatttggcaggacagatttgctgctggtattattctcacttgacagctattttcttcaggacttggacaatgtcacacagttagttcccttctggcctgcaaattttcttgagaaattcactcattacctcataagactatgcttataaataacatatcacttttatcttgcaactcacaatattctcttgtctgtgacttttaaaattgtgcttatatatgttcttgttgtaaatatctttgtgtgtattctagtttctttgttaacctttttaatttttacatcagtttttcttataatttttcagttccttttttatattttttacctccacaatatctgttttttgatatttttaatatttttgttatcccaatttttatgatttttaatagttgtctgtgtttctatttcattcatggagtattattcaatttatgttaactttttaaaattaattttttaatggttgctttctgaaaattttataatatctgatagagctatgttgccctaaaattttgtatgcattgtaatctttaattgaaatttgaacattaaaaacaagctacctgtcacagtgtctataatgtagctttgtcctggcaaagtctgaaaccatttgtcttagctagagatcctgagagtctttcaaacatgttcttaggatgtgtcttgtctgaaatgttctagttgttttttagttaaaagactttattcatgtttcttcttaatagtcatcacttgccacaactgttccctgtctgtagtacagtctctttcctgctgtaacatttacctttgatctcagcagactcaaaatgtcattccaaagtataccactgttaatttcagcactttatgtcattggagacagaaaccagtgtccgccaaagcacctaataaagccagaaataaagatgtgggtgtgttatttttcttgtctgttgaaaaagaaagcaaaagttggtaatgtacttctaaagacactatgttatactgaggagcagaaagagctgtgttgggtaaatgtaaccaacttttctcttccttccatgtggcttttggaattgtgataacctggaacactgcacacacgtaactcatttataaattttctataaatgcattttggtcaatatgctcttgttacatttatatgtctatgaaggaattagaacctgtggtattttgctatgccatcttgcttatgtagtttctgtaactttatgggttagatttgtaaagtatattcatctgagtcgagcaagtgaagtagtttgttacttttatttctttcagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtggtaaagcctttaaccagtcctcaacccttactacacataagagaattcatagtggagagaagccctacaaatgtgaagaatgtggcaaagcttttaaacaattttcaaatcttactgaccataaaaaaattcatactggagagaaaccctacaaatgtgaggaatgtggcaaagcttttaaccaactctcaaaccttactagacataaggtaattcatactggagagaaaccctacaaatgtgg

SEQ ID NO: 15696 - DNA, 3116 bp, Homo sapiens
attattattattattattattcacaacagacactttccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagatatttttccttaacgttggtgccagtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttcagggctgacatgctgcccagtttgcttcatcgggagaatagcaacaggtagacacatctcaaggctaaatctgctcatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactgagagaggaacacgtactgcctgtcataacagcattgtaatgccagtgtctcagtaacagaatcctggtgggtgttaattgggtgttttttgccctggagaattcagattcctttctatacctccgattctgcccagaagagggggggaatcaccagtgttacaaaattagaagattgttttgcctgttttagactgaatatttgaacactgcagcattactagccaccagtgttaaaggacagatgaggggaaacatttgtttttagcagtaattccatgcctcatcttttttaagtgatttgttccaaatgaagccatttattgacttgatgttcacaaatatcatttgaagaaataacaggaattggggttagatgataaattctagggaatctaggtgatttggaggatttcatttgttttgcattacagctagttgctctcactaaaggtaaatttccggtgaaataactcaggtttaactagctgtgtgcccagaatcactgttccttcatacatgtgtcctctccttaaattcattactttcaaatgatgttcaaagcattgactattttcattcaaagaaactacattcggccgggcacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcatgccactgcactccagcctggccaacagagcgagactgtcccccccccaaa

SEQ ID NO: 15697 - DNA, 1172 bp, Homo sapiens
aggactgcgagttattgaaattaccatttatgaaggcagaggcatgagccatggaagataaaccatagaattaaagatcctacttctagctgggcccctcatgtatccattggccgactgcagagtgtctctacctcctctccagagtatcattcctatctgctgccagagccacactgccatttactccaaggactttgtaaaattccacacctggaaagacctttagttgctcagtatccactttgtgtctccaaattgtgtaggactctgtaatcttttgactagtttctgagaaaacacaatgaagcatttcactttttttattgaaggccatttaataaaacacagctggtcagcccagtgcaaaccttattatctgccaccagtatgtaccattggttctcctcattccttgggccagcttctcaggtagctttagacctcaacaagttgtatctttgccagtgttccatcttgttcccctaaattaataaaatgcttttctccaggattttggcaaaggttggtgtggctgtggttttgctaatgcacctcctagatttcaaagatttaccagttttaccatgactcatatattaagatctgtttctactattcagttcctcaaactgaagctcattgaaaaaataatgtataatgttatttgttttattatagcaattattcctcattaaagcagtatttaatgcaatttccagttatttctttggagaatgttatgtccttgttgcattaccttaaaggttgtgaagatgtgatgtgtgttgcttgttcatcacaaaaatcagtaagcacaataaagtggatgccaaaccatcaaacacatagatgttcctgctgggtccctggatatgtaataagcaggtataaaaatattttaattatagttttcttacaaatataacttacgagaaaaaaatttgattggaataatactgtatattactaatttttaactatccctacccaaaccttatgactcacagaattttctcatatacagtattcagtgcacagaaaacttatgactggctcaagtacagtaagttacttctaagtaaaactctcaagtctgagtccatatttgtagctctgcttttggttgtacgtttctaggatcagggccgcttatgccttttcgttcatcc

SEQ ID NO: 15698 - DNA, 1702 bp, Homo sapiens
cagaaatttatttaaggggaggaatatttatgctttatttgattgacaatttaaaaataaaaatttcttgaccattacttggaaatgtattttcgtcaagtaaaagcatacaatttttttttttttttgagatggagtctcactccatcacctaggctagagtgcagtggtgcaatctcagctcactgcaatctccacttcctggattcgagcgattcttctgcctcagcctcctgactagctgggactacaggcatgcgccaccatgcaaaatatttatatagcaaaattaggtatttctatctataaggtatttgctatttggctttgtctataaatgatcatttatatggctggaaaagtttgtatccactcttttattcttgaacgtaatatatataattgggaaaatagacattatcctctgtaccatctttttgaggtagtgtcaggatttctttccttttacagctggaaatactcatatttagaaaaggtgggtaataggtactataacaactcagtaacaggactggaaagaggatactcatttgctagctcccaagagaatgctacaagttaagttgttcattgacttcagaagctgctccgtttgcttgtaccagagtttaggttttcagagcatgacttgatagcataggttgggcataggagaatttgagcaattattttcgtcattgcctgtgtaagagttgactgtgtggcaattaataggcactgtttggccgggcacagtggctcacgcctgtaatcccagcactttgggaggccgaggtgggtggatcacaaggtcaggagatcaagaccatcctggctaacacagtgaaaccccatctctactaaaaatacaaaaaattagccgggcgtggtggtgggtgcccgtagtcccagctacttgggaggctgaggcaggagaatggcatgaacccgggtggcggagtttgcggtgagctgagatcgcgccactgcactccagcctgggcgacagagcaagactccgtctcaaaaaaaaaaaaaaaaaaaaaggcactgtttgcatgtgccatttgtgtatgtgtttgcttctaaggaaagtccaccaagagatcattttgttctgtttatttggaattcagtttcctcaagtagttgtttacatccacttgactcaccattttaagcaaattttacaagaagtgtcaaatggaaagtcagcttcagtcatctaattcattacttaaggaaattaagtaactgcctgcctgtagtatagatttagacagttgttttgtttttttttttactcaagcattgctatgttaatttgccaggctgcttttagaaagcaccagacactgggtggcttagacagcaaacacttgttttctgacagttcgggagactggatcaaggtgtagcaggtttggtttcttttgaggcctcttgcctgagcttgcagattgcaaacttcttgatatgttctcacatggtctctcctctgtgtgcacaagtccctggacttttttctagacagtctttaaaatgcacttagagtatttgctttaaacacatgtcaataaaatgagtactattctttctttctttctttttttttttttttttgagatggagtctcgctctgtcgcccaggctggagtgcagtagccccatctcggcacactgtaagctccgcctcccgggt

SEQ ID NO: 15699 - DNA, 1374 bp, Homo sapiens
cgcccggtctcaattttgttttaagaatatcaaagaatccaagactgtttcagcttctttctacctaaaatgcagtggtgataactggtgactgatttgtaagcaatctcaatgtaatgataaataaccttttcctttctctactagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaagtgagtagaagatacgttttttattttgactctatatttagctaataatgatctatacatatgtatgtatgtgttttatgtatatatgtgtgtatgttcctgtgtgtatatatagaaactgaagaccttttctggaacagatacagcttcattgatgaggtttctttttttattaattctctactagtttattacagatgttcacttatttatacttcattttttcatttatatatcgtggccctctttatttgtttgatggatacaaacccaccttacag

SEQ ID NO: 15700 - DNA, 1221 bp, Homo sapiens
tccatcctcctggcccctgatctgcaggaacctccccaaccgcctggcttgtctaggcctgtagctgggaaggaagagacgaagacacagggagaacacaccgggactccacacctgtaaccacattctgtttgttcgccctaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtagttacatgttttcattaatgtgatttcagagaagcacagaccttatcagatgctgatgtgataaaccaaagtttccttggttggctgtattgtagatactcccctggagccatcacctttttttggaggggggtggtgggtagaggcagggtctcgctacattccccagcctgggctcaaacgatccttctgcctcagcctcccaaagtactaaaattacaggtgtgagccacggtgcttggcctgcattatcattttgtagtgaagttttctttttatttcaagagagaacctattgccatccactttgagaatcctgttctatttcatgcttgcagactgtatttaaggacatggaagttactatttccacttgttttctagaagcctttgttatgaaacccaggatgtccagatagtagtaataattcccatattgagtgtgttcacatatgtgccagccatgaaaagggtatataacatgttatcccatctctgccccaaaacttgtacctatcca

SEQ ID NO: 15701 - DNA, 1254 bp, Homo sapiens
cgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataat

SEQ ID NO: 15702 - DNA, 1104 bp, Homo sapiens
ggatttagtaacttcactgtctggttgatatgtgcaattagtgtggcatcctggtctttgggtaggggctgagttacctaggcttcccttttttgactggtttccctggcttgctgtcttccaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtttgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttctt

SEQ ID NO: 15703 - DNA, 1427 bp, Homo sapiens
gtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagtttt

SEQ ID NO: 15704 - DNA, 1198 bp, Homo sapiens
agtagctgggactacaggcgcccgccatcacgcccggctaatttttttgtatttttagtagagacagggtttcaccgtgttagccaggatggtctcgatctcctgacctcgtgatccgcccgcctcggcctcccaaagtgctgggattacaagcgtgagccaccgcgcccggcccagacttgattattaaaagacatctgctactcaaatagatgccacccttaatctgtcctaatcaagtaaaatcttgttagttatatttgggtagaggaaatattgtaggctaatgaacagtggctgtcaacagttatcttgaaaatctagacttgtagccttgaaggagagggacccgaactgtgaagagatttgtcactaaccatgctatattggatgtaaacctgggagtggttacaggaggtggcttagggtaatatgtgctggcatctttaagtatttcgggaagagggatttagatccaagtggtcactcctactcccattggagacgcaatttggcattgtgtataaaagaagagtttttctaatagtgctgtgttagggtcctgaattccagctgctgccattcaaacaggctcacttaacactcacctggattattctaatgggaattcaaactgggtattggtgacctttgagggctctccctcccaaagagactatgagtgtgtgatttttcagggcaaaatgttctaagtaaatcaagtcatggttcaaagtctagatccgctccttgtaattttttttttttctttttaaagaactcagtcttgggtgctgtttacttcatatttaagcccatggtccccatgtgtattgaactggcacaaactaaacttgtctgctcctctaggtctcttctcatagtctgagttcttaaaattaaggtcagttaaaagaagcaccttggcattttccttattggagtttgctgtgtgtttgcaaatcaaaatgggaattgattcagtcatttgggctatacaggttttcatctcaagtcacttaagtgaaatccataaggaaagatgttcatgctttacctaccatagggctcactcacctcttttcttaaatacaaaacaaaaagcacctgccagttttaagggactgaaaaggtgttttatgatggctgaaaatacatctgagaataataatatagttatacctagactggtgataca

SEQ ID NO: 15705 - DNA, 1217 bp, Homo sapiens
gggctgagattctattttgagttttgggatcagtaatttaaacacagggacctctacgagttctctggaaaagcccattttgagaccctgaacagttgttatgccaaagcaagctcttggggtaaggttggcagtgatgctgctgataaattacttttaagatgcttggggctgaaggacaatgattttgtaatagtgttttaagttctcaggctgacctatgaaatctggaagtgctcatctgaaaggccagtattctttctgacaggcacaggaaaaactcgtcccctgcttgatcctcatgcaagcatttcttggaggaagccaggcctgtgggtcttgggggccagaacagagacactgagagcaacactactggcattttgaatttctgctgaggctgcaaaaacatttcaagggaaatctgaagttatcccttcactgtctacagcctcttgaattgacttctgggtgttacagatgggaccagcgtgtgtaaaagcagaatttatattctatttggatatcagaatcaagtttctctttttaaaataattttatggtaagtcgtggtttctctgatatgatttctgttgtgagcggaacaaaaatcatggcgaaatggtgttattacttaaccaaattgcctcgtgtacagacaggctgaactggtgctttgcctagagttggcctggagttttcagaaactcaattgtggcctttataaggctgtgcctggggttgtatttccaatctctctcaacttttgttcttgtggaagggaggaagtagagctgtgacagatatattgccagatagcacacaatagcacacaaaacgagaaagacacggcgtgagccattcatggagacagatttacgctctgtgctgccctcaaaccatagatccatctatttcagagaaacaacttgcccactgtattatatttcagacagggacatggcttagaagagagatgctgactccttctgtttagcttttgccgataatgctgcacgttttgctgtagaattacttttgtggggatgggaaagtatgtttggcaaaggaaggcctgtctctagattggaagtggaagaagggagatatcaggagagtaattggccatgctgtcgccatagtgaagtatatgtgtatatttttgctgggttttgtttccagccaactatattatcaggtgttggattttttaaact

SEQ ID NO: 15706 - DNA, 1140 bp, Homo sapiens
aaagccctgcaggtaattttttttctactttttaaaaattataatttttattttctttactgttcttttaagacatcctgttatagcatctgcaggtgattttgatgcccagccatgtttggggaaaaaagtttgggttctgagtgaaaatagaaaacgtaatgacatggaaaggaagtcaggggataagaaaagctctatggccagccatggtggctcacacctgtaatcccagcactttgggaggctgagatgggcagatggcttgggctcacgagtttgagaccagcctaggcaacatggcaaaaccatgttcctattcaggaacaaagaatagatcacaaattaaactctgtgggttttcataagtggaaagttggctttcgttgttctgtatttgggtgcttagtggacaggagttatctaaaagaagtaattatagttgtaatgcggaccctcaaagttgaaagtagattgaaatccattattttacaaggtggccttactatttatagtttgactgtaggtatggcagtgagagataaaattactttttctagctttgcaaaacgccaaacgtctttgaaattaagagtaaaaggggtttaaaatatgtactgctttataaagcaggaaaaccccactggaacattttgggtgtttacagaaatgggtattccatgggagagaacgtggtaacctatgttttgtcatcatttgtttaatcactgaaaatatattaacaggccaggcatggtagctcatgcctgtaatcccagcgctttggcaggctgaggtgggaggattgcttgagcccaggagtttgagatcagcttgggaaacacagtgagactccatttctacaaaaaaagaaaaaagaaaaaaaagtcacatgtggtggcacacccctgtggtcccagctactttggaggctaaggtgggaggatagctcgagccccagagatcaaggccgccgtgaactgtgatcgcaccactgcactccaggctgagcaacagatcaagactcttgtataaaaaagaaaaaaaatttttttaaaaatataaatatagattaacaaagtaacagggaatataatattttcaggttggtcatatagaggaaatactatattgtgttat

SEQ ID NO: 15707 - DNA, 1160 bp, Homo sapiens
gtagttaagttttttaaacactgcgagattgctgacatacactgcaatatcacgtgaataatttatggaggttgctcaagacaagcttttttttttttttatgtgagaaaccaggggggagtgggggaagaaggatgagagggtctgtgggaggggccaggacagaagagcagacacaactgcatgtgctgtgctggatgttaaatgtttctgctggtgtaggcagcagcatttgggatttcagggaggtttgtacaatacgatcttattaataacaattctgtcaagagagcacccgattaaattgaattgggtttatgactccctcttggtttctgaaaatgtgtggatataaaacctctgcgatgtgaatattggataacaagggtaggtttctttatttatttatttttttggttggttttaatcattcctcctactactgagaatttgcttgtttataaatgcaggggtaggcatttttcccaaactatctttctgttttctgctctcaaaataatctagagaagatggaactggcatcagtgggcagttatcctaagaacgtgactgcttctaggcatggtttgctggacaactctgagtctagaatatcatctaattaacacctgtgggacaatcctcttcatctgctaaaatatactttttttctcattacaaaatgagtaaattatataaaatgtctagagtacaaagaggagaataaaaataacctgtaagtcctccccctgctaataaaattggtatggtttttgtttatatccttctagtcttttttctgttcatatttagtgaacataatttagtgaatcgtatatactgtttagaagtcatcttttttttttcactaaacattacatcacaagcatattcccatgaatggtctatacggaatgtcatttctaatgattgtagtgtgtatgtgtgaattaactatactttatataacctatctcctgcaactaaaatgcagtgttagtttataatttttatccattttagacaggcaagttataaatatattttttggtcaaatttcagtatacattcttgatcatttctttaggaaagctctgagaagtagaatttctacaagaagcagagtgagtctgagggaaaaaatcattaatgtctcaaga

SEQ ID NO: 15708 - DNA, 1238 bp, Homo sapiens
gggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgc

SEQ ID NO: 15709 - DNA, 2288 bp, Homo sapiens
acacctgtacatagtgtccgctgccctgactcccgcttagcgcacccttaggcaggcgccccttccacctttccccgagagccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccggttccttgcaggattccctcctttttaaatgcccttgaatctagctttgccttggagaccccagtgggtgctgctcctgccattttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgccctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccagcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggtggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagcacctgagctagtttacctcagttccgcaggcaggacagccggtccgggaaccctgagtgagtgtgagtgtggatgtgtacagtacacgcactggacggcagcgggaggctgggactttccattacaaatagagacttcattcctgttgagtctagttggaacttttagtatgaatgtgagatttttctcctgcttgtgacattaagaataaaaaactgtgatctatcgtagagtacgttctgcattttatttttgcaggcaacactttgctcaccagcaagaacacagcccaaggaagggacccaataacctttcaaaacccaaactgcttcctgcggtgagggcccagggtcctccacggagaggacaggcatcttcctttcccaccaggaaggagtcagcccggagcctctgctatgtgcaaggcggtgtgcaagcaccggctgcggctctttgctgtctcttctttctctttggggctgggctgggtgtgcgttctggtgctgatgctttggcctgtgaggctgagctagagaagtgtagatgttagatgtgccggtgccatcctgcgcctcccaagcacgcccccactcactcaccttggcacctcgacccgttcaattacagcaacgaagaagccactgctgagtgtggtctcaggggaggcccggaggcagtgctcggcacccgggaacgtgctcaggcctcggtggggccag

SEQ ID NO: 15710 - DNA, 1087 bp, Homo sapiens
agggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctc

SEQ ID NO: 15711 - DNA, 1130 bp, Homo sapiens
cgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctggga

SEQ ID NO: 15712 - DNA, 1226 bp, Homo sapiens
atcgcttgaacctgggaggcggaggttgcagtgagccgagatcgcgccactgcgctccagcctgggtgacagagcaagactccgtctgaaaaaaaaaacaaaagaattcctgtcttctctccgaaacaaagcagcatcagtgcccccgcaggtgggagggagcgcttgcaggagggagcagtgggtccgccacgacggtctggggagcaggtggggagggggcagagggtgcagcgtgtggtgggagggaggaagccacactgctatcttcaggtgcttcccgcagctccatttgcaaagagcggatgggtttggggaaggaaggggtccccaccctgtgccaatacagcgtatcagaggtatgttctctgggctgtctacaggttggcttggggtcctggggaggggcaggccaagcgggcagtactaggatcgggtcccagcatgacccggcttcaccttcccagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggtgagtggttcagccctgcccatcatggccctcacgggaagccatgggggagcccaggagagctgtaacctcccaagcccctggcccctcccagcctccttggctcttcagttaccctgtgggtcctgttgctcctataacacacttagtggcagccaggcacggtggctcacgcctgtaatcccagcactttgggaggctgaggtgagtggatcacctgaggtcagtagttggagaccagcctagccaacatggtgaaacccccattctttactaaaaatacaaaaattagctgggcatggtggtgggtgtaatcccagtactgtagtactgtaatcccagctactagggaagctgaggcaggagaatcgcttgaacctgggaggcagaggttgcagtgagccgagatcgcgccattgcactccagcctgggtgacgagcgaaactccatctcaaaaaataaataaatagaagacacttagtggcttaaataaatgatcatacagttctggagtctgaagtccagcgtcagcctcaccgggctgaaatcaagacgccggtagggtgagctccttctgcaggctccggggcacctgtttcct

SEQ ID NO: 15713 - DNA, 1292 bp, Homo sapiens
ctggcatcagggacacaggttgtcagtaacaggtacttggacccaggctgcctgtcttttaattaacattcagagaagaatgccctgattgccaaggatatattttcagctttgtgaagcaaattttatgtcagttacctgagtagtaagttaaatcggcactttaagcctctttcttcagagcattttaggtaccaagtttgaaatctacgaaatctaatcctcacttagattaaatagtcattcagaagtcagaagagctctgcagatggcctgagaaaggtttgaatattatggttaaaacattcaagaagaaagctttctagaaacgcagctgctatttcagtgcatgttcagttagcattttctgactgataaaatagaattgagagggaggaatgccagtcagggttctatctattgaaaggctctcctagtctgccatcatctagacaacagaatggtagttgtgacgtggagaagtagtatgaataggatcttcccacatctttaacccagaattacttgaggaaatcggggtcttcttttcttttccaggattctgctatgtagaattcgatgaagtggattcccttaaggaagccttgacatacgatggtgcagtaagtatcctcgggttttctctgtcatagcagttgagattgttttctttgccaatacttacactattttccctttatcattagctgttgggcgatcggtcacttcgtgtggacattgcagaaggcagaaaacaagataaaggtggctttggattcagaaaaggtggaccagatgacagaggtgattggttcttctaaagctgaacatcataaagatttgcagtatgcctaccaattccaactcgtgaacgttcctagtagaactcgattatctcataggtgtgataggttctcgtgagctcttaaaagtttgcgtaaaatcctagaaagaatggctgatgcttctgcaagcctggcgttttttgttttctgttggaagcaaaagctcttaaaatgatttcattgaaccttccatcacttgagttgtatgtcttccaaatgaatttttccatgtttgcgcagcaaggtaatgacacgacctcaactttatcttttttgtgtatcctcaggaatgggtagctctcgagaatctagaggtggatgggattcccgggatgacttcaattctggtatcagtatttaaagtatcaccacttaatttttcctaggagccttgctgctgttctctgtttcttacgagtagcccgcctggccggactacttatttag

SEQ ID NO: 15714 - DNA, 2268 bp, Homo sapiens
cctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaatgcttgcctttatttttgagttctttttagctgctcatggaatgtaacaattttaaatttgggaagcaccattgaaatggaagagtcttcctgtcattttaattctgggatgagtgaagttattttaaaagctggtgatgattagaaataggatgccaattttttcccctcacttgctaaaaatgtccttttcccaaccaggcagaaaccttgaaagtctggctgtttttggttaggtaaaggaacatttttttcccaagatggaagaaatcaagcatttacacaacatgtggcttcttttaacaactgcttgtaaacgaaattctaggtgcccctcatggctgggagggctgctgcttcctgacagcagatcctgactctggggaggtgctgctataggttggtattggatagtgttaaaattgacttaggcagacaaagaagagctgagtgggcaaggtgcggggcatgaatgc

SEQ ID NO: 15715 - DNA, 1183 bp, Homo sapiens
acatacgtaggactttggctgtcaccaaatgagatgggagccactggacattttttatttttattttttgagacagggtctcactctgttgcccaggctggagtgcagtggcatgatcttggctcactgcagcttcgaactcctaggctcaagtgattctcccacctcagcctcccgagtagctgggaccacaggcgtgcaccaccacacctagctttttgtattttactttctgcagagatggggtcttgctgtgttgtccaggctggtcttgaactcctgggctcaagccatctgtccacctcagcctcccggagtgctggaattacaggcatgagtcaccgcacccagcccagccaatttcctaacagaaaagtgatatgattttgacatttctgcaggatccctctggccgctacatggccagagtggagtggggacggtgggaggtgatggggaccgcagctcccgggtcctgtgtgtccagcagcctgtctaacactcagccttgctgtttggttgtctttccagcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggtgcgggtggggctgggcgcagtggctcatgcctgtaatcccagcactttgggaggccaaggcaggcagatcgcttgaggccaggagttcgagaccagcctggtcaacatggcaaaaccccgtctctattaacaatacaaaaattagccaggtgtggtggtgggtgcctgtaatcccagctacttgggacgctgaggcaggagaatctcttgaacccgggaggcagaggttgcaatgagccaagatcatgccactgcactccagcctgggtgacaaagtgagactctgtctcaaaaaagagaggtgcgggtgggcgtaggggtctggccttctgctccgggcttggcttgggctccgggttttggggcatgtgggctaagcaggggcctggggaggcaatgatggggcaggggcagaatgaatgggttctctaacttaacacagagaataagacgagtctgagagaga

SEQ ID NO: 15716 - DNA, 1204 bp, Homo sapiens
tcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggc

SEQ ID NO: 15717 - DNA, 1163 bp, Homo sapiens
atctactttctcagaccgataactttagcataggtataaatcgatcacagagcctcaaaatccacccgatatctgggccatgatgtgaaatttggtaggtaatcgtcccacgttatcaacttgtaaagtagaaatggaagtgggggggaaaactcagccgccagtggcgtttgtgaaaagcacctggtaacaggctgtgctggaggggagttcagcccctagaaaagatcacggattaggaattacataagcataggtctcgggtccttttattttggacgcgatcctttcacgggatcgcctccggatgggagccggatgggatcccggacgggatcgtctcgctgggagccatgcaggaaaccgcaagagtcagaaacaggcgttgaaggcaggcagcattttccaaaacagctgtgtctcgggagctgccgggctgtagcgtctccccgagtcgcgcgcgcatgacgtggcgggcgcgcgatgacgcgacgcgtggcgcggtgcacgctgggatatttaagtctcctccgcggcgcggagccgcgatgtctccggcggctgcggcggctggagcaggcgagcggcggcggccgatagcgagtgtcagggacggccggggccggggctgcggcgggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccacccgcccgcccggcgccgcgctccacaccgccctccccgccgacccatcgcgttcaccacttttacccctctctccccactcctcttctccgaccctccgggaggccttccccacggtgagatgcgctgattttcccagatcatcctctggctcgg

SEQ ID NO: 15718 - DNA, 1203 bp, Homo sapiens
cgtgaatggtctctgtcaagcgggccgtctcccttggcccagagacggagtgtgggagtgattcccaactcctttctgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaaccc

SEQ ID NO: 15719 - DNA, 1758 bp, Homo sapiens
agccccggtccccagaaccagtccgggaagccgctggggagggggcctctgaggtttgggtgccaggtgggctggaagaggccctgggtgagtggggctggcctgcagaacgggacttggggccggggctgggcaagggcctcggtgtggcggtggagctcacacggccctccccacaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggtgagtggggtcccatgggggagagggggtgacgactgggagccccgcgctcaccccggcccctgccacgcaggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtgagacgggcgggcacccacgaaggtgggcatgaggctggcagggccacagccacagtgcccccctcacagcaccacccttggccccaggtctacgtccagcacctgctaaagcaagaccgagagcacctgtggaagttgatcgaaggcggtgcccacatctacgtctgtgggtgagtgagtggggtcactggaatagggggcagggaggacaaggccctgcctgccacagttggcccagcccccagcaccccctcttcctgcccagggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgtatttgcctggtattgtgtgagtagatctgggacctccacctgcatcaacttaactaactcagaccccaggaacccatgtggtggggccacccagccctcccctcccccaggagaacacacacgctcaggccacctctgggcctctctttattgagggcactgggcccaggtcttccttcagggcccacagcgcccataaaacccaagggagaatagaagagaccccctgatacacgcacactcgaggggcgcctcccatcccctcccacaacacacaggacagaagcccctctgggccggcag

SEQ ID NO: 15720 - DNA, 1252 bp, Homo sapiens
cggggagagacaagaacccagaaacaggctctgttggggagaatacggtgaagtgttcctgatgattgagttcctggcgtccaggtgcttgtcgcattgtcctcgtgttcacgaaggtggatggtgcttgttttatagctaaggaaacacatttggaaggtcagtcattgtccagggtacctgcctagacaatcacagtgctgggacccctgcctggcaccctctggctctgagcctcgcactcctgaccgcagctcagtcccacccacctgctcagcaaggcgtccccagcaaggcacccagaacccgcatgtgtagagagactcctcggcagggctgatggagcgacaggtcggggtttctctaacaagcactttcctggaaacttcattttaacatgttcccatctccctcagaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaa

SEQ ID NO: 15721 - DNA, 1098 bp, Homo sapiens
tccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacacgtgagtcctggcgccaggtcggggtgggtgggtggcgtgggggtggggtcagggaagagggcacagggacccacccggtgtgtaatgtaacgcttgcctttcctctctgcacgtccaggctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgtcactggcccaggccctggtgtttgtggaaggaagcctcaggcacctgccatttgctggctttcaggagtcatctttgctcaggcccgtgctgggccatgtgggtacactggtgtaggttgctggacacaggctgactcacatccataaagacagaggtcttagggccgggcgcagtggctcatacctacaatcccagcactttggggggttgaagcaggaggagtgcttgaagccaagagttctagaccagcctggacaacatagtaagactgtctctaaaaaataaaaattaggcagggtggtactgcacgcctgtagtcccagctactcaggaggctgaggcaggaggatcgcttgagcccaggagttgtgaagggtaca

SEQ ID NO: 15722 - DNA, 3115 bp, Homo sapiens
aaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtcaggtggctgtgggattttttttttttggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggaggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgccagtgctccttagcttcattgtgtgagttttactgtcctttgc

SEQ ID NO: 15723 - DNA, 1134 bp, Homo sapiens
agctgagtctaggttccagcacgagcactagtgggaacttgagcaagttcttatctataaaatcggggcgataataatacctcataaagttaatatggggattaaaacataatgtaattaggggtctggctcatattaaatgctcaatggcaaatcctatctataagctacatgtgtagtaaattactcactttctggtgttggatgagctgtgtaggactattggcaaaagcagatctagtagttaataatgtgctaataacccatattcttgacagaagttactgtgaatgccgagagtaaggaaactttgggcacctgggaataaggaaaaggtttaaataaatactgtatgctgaggagtaaaaacagtgtctcaggagcaatgctaccctgtcagtcaaatttataatagactctggtacttttgatttctttatattactaagctctccattatatttattacaggttctattattgtcaaggtcccatcttcacttcaagctcatttacagttatcagggaaagaggttgatgtgaactcagaagtccatgttcaggaaatggctgaagctcgtaaagatgatgttgtaacagtgactggtaaggaggctgcattttgctctgtcagatgaatagccattctccatacataagtagaaatgtggtacacttaacggaaattttagcttttttatatttttccattattatgtcctcatgtttgacatctttttttcttctagttgcttatcattaatatgatgcagacattttgtttaaaaagacctcattaaatcatttaggaagactcattagtcctgtcattgggtaaaattgatttttaaattttctagaagagctgttttctaattctcgaacttaaactgaatacatatattatagtgcaaaatttaaaactaacttcgtgtgactggagtaaatcggaattttgtttggtatgtacattttaaacttgctctttcagaacaacaaattctcagtagcacaaatgtgaatcgtttttgtacatttttcattatatctggctacagtggtggctgatactatttttttaaggtttgtcattggttggtttttttgttgtttgagacagagtcttactctatt

SEQ ID NO: 15724 - DNA, 1162 bp, Homo sapiens
caccctgataaagtgatttacctttctgaatcttggcagtcttcctctgtaaaatgggaaaaatgtaatacttacctctctggtttgttgtgaggattaaatgatagttcatgtgaagtagctaacatggtatctggtgcagagaaaatgccaaataagtgataactattattgttattaatgatgaatagtaactgattattattgtcatcttcatcactgtggatatttagttagctgatcacagtgatttttgattcccaagtccttcatcagtgaagctaccagaatacccaagtatctcttgtttttccctttgagtccaagtggcttatttaatccctttaacagcagttgacatttttttccagttgatgtcattattcgaagcagtgagtttctgtttcattccttattgttcttttgttgctttgtcagtattaatacagaaatattgaaaatgtttcactagtataagtcacacttactctctttttcactatatgtatttttaaatttgtctttcagggtcaaaaattgcatgttcaaacaaaaggaggcaaagtgatctgtctgggaacagtttatggaaatatagatattcatgcatcagataaaagtgtaagattgaaactttctttttttttagtaattgcaactttgcttccatttggctcactaagttggtaggttctacaaagttcgtagcataacattccctttttaatgcattttagttcataagtaaattcaaatttgaaattgaagtgatgaaataatatacaacttaagttttagtttgtggtttaatacttttgacagttacttagttcctagtctggaatcaataaaaacttaaatgcttactatttaactcaagttctgaaaagatttttatttttatgatcatagattaaaatagatgattaagtaatatcaccagtaactggattggatttttcttgtgttaggtttatttgagtattttctaagacctttttacttcgcccttaggcaaattgaaggatgtttcaaaactcagctttcttcagtattttccacaaggtggcaccattagatagctttactgctctctcacagctttttttttttttttttttttagtagctattgagattttcgttgttataggaagatagtt

SEQ ID NO: 15725 - DNA, 1221 bp, Homo sapiens
tcctcctttgagtaccttctccttcttttagtcttaggctttgtttacatcaaacttctcaattccccacatagattatacattgaatctgctgtgcttatgtatatttccttcactttttatgggataaccttcttttgatatccaactatgttgtagctgcacacactcaacagttagccatagcctctttattccctgtatactgcagtcatactttggctggacataactgtctccccatcttgaatgctgagggtcaagaacagttttgtttccacagtgccaagcacagtgtctgagatgcattaagtggtgttcaataaatgtttgcagtaaaccagcaggtatttaagttttatgtgaaaagctgaagaagattttactattttctgaatagatacacaaagttgatgtattaaattttctgttttagaaaataccagaggaatttaatgtatttaatttaatacaagaaatgagaacacaaaggcattctgcagtacaaacaaaggtatagttgtttgtttccctttataaactgctattttataaatgctttcttcttttttaaaatgttgttttcattttgttttttaatcatttttctccttcataggagcaatatgaacttgttcatagagctattgcccaactgtttgaaaaacagctacaactatatgaaattcatggagctcagaaaattgctgatggagtggtaggtgttcttggtctattaattttaggaaacttttactctttgttaagatgtaatatttagccttttttttgttgtcttgtgttttgtctaacatgagaagaatatccaggacacttaacatttttacttaaactcatttccttcttattcgtatctgtattatgatggctatttaatgactccgatataaggtaaattatgttctaaatgaaataaagttaggaaagatctcatgtcaaaaatcatataattcgttaatgttttacttttttaaaaaataattgcattgttctctttactcttcccttccacccccacccaagtaattctgcattgattctacttgaatttcattttgtataaagtgttttagttatttgtgtatatgcttttcttttcttttcttttttttgagacagagtttcactcttgttgcccaggctggagtgcaatggcacagtctcagctcactgcaacctctacctcccaagttcaagtga

SEQ ID NO: 15726 - DNA, 2436 bp, Homo sapiens
acatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaactgacaattcatttaagtcatttgataatgattctctgctggtatatctatttagtgtggtattgtagtgcaaatgtacgtaattcaaatctagtaaatatttaagttcctcacactgtgcaggcttttttttttttttctttttttcttttttttgatacggagtttcattctgtcaccaggctggagttcagtggtgcgatctcggctcactgcaacctctgcctctcgggttcaagtgattattctcctgcctcagcctcctgagtagctgggactacaggcacgcaccacaacacccagctaatttttgtatttttagtagagatggggtttcatcatgttggccaggatggtcttgatctcttgaccttgtgatccgcccaccttggcctcccaaagtgctgggattgcaggggtgagccacagcgcccagcctatgcaggcatttttaacaaccaagactcagttaagaaagtgtgcatctgcgtgtgtgtgaatgtgtatatatatgtatatatatatcatattttgcataattttcttaaattgctgaataagatcaatatgtgaaattccttagcccttctccccaaaatacattgaaaaaagttttatattaaactattaagaaagcagtttaggtaatagaaacagttttagaaagttgggagaaacaaggtatgttaatgataacaaaggcttctaactaatagttacgtggccagattacatagcctaccatagattttttttattgtgtatgggatgataagaagtttagagaattttcttactagtaagtacctttactaagtaatagctaagtataaaatctttagttacagaaagcttgtgagcaattaaaatccttttacatttttcttgcagaatgggagaaaaatatggcaaatacaaaactgtaaaataagggcaatgacaatgactcaactgccatatagagatataattaacaaaatactttgtggtacctcttatctctcaggatctcctccctaccctagcaaggcaaacaacttggagtacttccttttcgaaagaagttctagaaattaaattgaggtaggagacggattgacagtgcctaactaaagatgagtaaaacagacctctttaatgatagactcactatttgacactgcttctactattgtaattaaaaatcagaagtctttgatgtatgcgttgctgtaagaaactctgctcattgcaaatctattttgtttgtttttggtattattctgggcacatactttggttgatgactttcaattggggttctttgtgctgccttttgggttactgttggtatttccatttctggcttaatttatggtaaccatcaaaactgcttatatttctggttagggcgaagccatttaggaagaagcatttcaccagaacaagtaaaagttaattgcagcaatgatgtcagttttggcccctagtttaataaaaggataggcaaatatcataggaaatcttcatggtttgtaggaaatcagtgtttgcaacgtaggaagtttcatgggatagggaaggtataaatcaagatagtaagggttttgttttatatgtcattgtcttaccatgctccccacctatttaa

SEQ ID NO: 15727 - DNA, 1211 bp, Homo sapiens
ctccagcctgggcgacagtctcaaaaaaaaaaaaaaaaaaaagcatacatctctgaaggtaaagtataaatcagtgggctcaagatttgcaggtacagccttgttaatgccttcaataatgcttacgttccttgtcttatgggttataattttcacatcctcttcagatacaatctgagaacttgttgactacctttgttacatgcaaaaattttctattttaatattgcattatattaatggtttcatagtacattccagttctttatctgaatacaagcgttttgcttttatttccagtttcttggaccagaacaataaaatacataagacatcgtttctatatggtcatatactatatagaataaagaattgttatgtaaattattaaatgagtatacagacctttacataaaaactaaggtacctcagtggaatctgctacagtgcttccccctccctacccctccattttgtttataaccttttagctatctaaataatacgtattccatactcaggatagctggttagctagcaaaagaattaacatttgtgatatttacttgcaaactttactgaagccatattcattatcttccttgtcaccaaggctgttgaccttaaataaacattaagttgattttgcacaacactgtatttgtgtgtgtgcatgtgcctgtttttgtgtgtgtatgtttgtgggaaataattatgtttgtttccgcatatattcatttttaatgcattctgtaacttttctcgagtggtggtcattgagggtagggaagattttattttttaagttgtcgttaaggtatttcattagtgttcctgagtgtaaaacagttttttcccaaatacttatggcagataagagcatttttgtaaataataaactagcaccgtttgggtaaatttgcattattttttggacaggttcattgtcatgtaaaacaaatatctcaaaattcattttacatttagcaaaggtgcaacatttgtttttggagtttgagagatattttccttgtcttccatcattcaataaatactaaaattgataaccacagtctttttacttttgtaattattttcttaaaattgacattttaatcttgtcaactttaaaagttcttttctgtcttcagtagaaaccgtaaaatcttgaattgactccaatttgaattttttttttactctaaagctaa

SEQ ID NO: 15728 - DNA, 1225 bp, Homo sapiens
atttaaaattttcgtttttttatatctttttatgttgcaaaagacctgtgtcttcactgtatattaaaatgagttgtatactaaaaggaatttatcaaactaagttaaaccatgaattgcaacttaacctgacaattagatcatttcttaaataaaacttcaaaatatatttttaaccataataaaatgggcaaaattttgtttctagattttgttcaaagaccagatgatttactaagaattttttgataagttagggcatgtctcctagaattgttatctgtaagacctcaaaacctttaagctgaaataggacattaatttacatgtttattttagctgttagatatatttctaaattattatacaaatagggtggtcattaaaatttagagaaatagctatctgatgtaattattaacagattataatttctatcagtaacctatccaaaataagctaagtccaaacattcttctgcatattttaatttttagatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagtacgtgtgatttttaaaatagtttgcctatgtgattttatattagccaatgtaaagtgacttagatatagtagttgcccttgaactaagtattttctccagaattaattctgtgagcgtttataacactgatgaaactgtaaatgagataaagtgttgtgattaaacttgattgacaatataatctgacaccttctgaattgatggcttcagtttttccaaaatgctttttttgagacggggtcttactctgttatccaggctggagtgaggtggtgcgatcttggctcacagcatcctcagcctcccaggcacaaacgatcttcccacctcagcctcctgagtagctagaactacaggcatgcgccaccatgcccggctaattttttttttgttttttgtagagacagggcttagccatgttgcccacgctggtctcgaacttctggactcaagcagtccacccacctcagccttctaaagttctaggattacaggcatgagccactgtggctagccccaaaatgttaaaagcacttta

SEQ ID NO: 15729 - DNA, 1176 bp, Homo sapiens
acgttaaatatgtaaggaagagtcttttttgggataagactagcactatatggtctttcaaagagattcaaatctcagctgtcatattcttttttaatgatcataagttggacaatgattactatgaacaagttgatatccatttgtcttttagcattagtatattgcagctgtgtagactgacaactaagtacttttgctgacatgttttagtatatttttgaacataggttgactaatacttgttacagaaagttctcaacttgtacagtttcataaccatgtaacttcttatgatatctgttcagtgtatatgctaactaattttaagatagaattttagtgtcttagagttgtgtgtataaatatattagctgtgcacagatctatatattccatttataaaacatgataaatatattcaccaatttttatttttagtgtcattaaaattgtgtgtgtatatagagatatatatacaactttatatacacacattttatttattaaatgtgatctatatatttactaattttttttttttttatagagtcatttgccctggctccatagttcccacccaggattagaaaaaataagtgctatagtatgggaaggtaatgattgtaagaaagcagacatgtctgtacttgaaatcagtggaatgataatgaacagagtgagtttttaaattttattcttgtagttcaagggtaagacttagtaattatatataagataattactggaatattatattagtaaccttctgacctcatttcttcaccctgaaaaaaaagttacatgtgtgtatttgtttctgtctgtaatttaaacagtgatttgtcaccaaaccactctcatcttctagtgttttcacttatctgaccaagaatagatgatacggtctataatttttctcttttatctttttctttcttttgaaattcaggagcttgttagatatatacaggtgttaataaagacttttctttggactagagattgttgttacaagaactttaaaaataaaaaaataattaaaaagacttatttttctgtatcattcttactggttcatttgtttaataggacttaagacatgaaaaaatcaaactagtaaatttgcattcatacttgcttacctacttaaatatatagaagtaatgcagatag

SEQ ID NO: 15730 - DNA, 2925 bp, Homo sapiens
tattagaaactgcacttgtttgtgaatgaaatttgaatttaaaaatggtgttatatgatataatttaagctttgatattaaaactggcttgtcaccacttctatttttttttttctagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactgacggtgtttttttttttaattttcaggtcatatacatttctatggtaattttgtgtttacttaacataaaatttagttagatttggggggagtgaaaataaattttttataactttccaacattttagattttgttatgattcttagaacatgaaagaataatacacaggtttttcatcaccaaaatgatattatatcattaatgtttgtttgcttctttgtttttgaatacagcaaactggctgtggcctgaaatattaaagctcattgtgaaaagatagtggtttttttggtttgtttgtttgttttgagacggagtctcacactgtcacctgggctggagtgcaatggcacaatcttggcttactgcaacctctgcctcccaggttcacaccattctcctgcctcagcctcctgagtagctgggattacaggcgccc

SEQ ID NO: 15731 - DNA, 1201 bp, Homo sapiens
ccttcttgttgccaaattcaatggtcacttttttagtgtttgcgttacttgatctgttggcaacttttgacaatatttattactccctcctccctgaaacgttttcacttggcctgtagaaaacattcctctggttttctatttttctgtccatttcttcttagtctccactgctgacttttccatgtcaccagaacctctaaatgtggagcaccccaggactaagtccttagactgcttctttgttttctttactcactttttaggtgatctcaactcaaggttttaaatactatctggtgttaactaccagatttattccagaccagacttctcattctctaaatatttagcagttgtctcaaactaatgtatttaaagcagaggttctgtaacttcctgaatccttacatttgcttcttttacaatcttctcctactaattagtagcaggtgtattcttccagtagttttgattttttttaaaaaaatttaacgttatccttggctcttcagtctcttccatctcttctttgtctacaaatcatagtggctctgccatccaaaatacattcacaatttgaactaccagccactctcacttgccttcaccctagtccaagccactgacctatcttttttgcatttgcccttcagactgtttttcttatagcagccagagtgagcctcttaaaataaaagattatattattccactattcaaaatcttccagtcgtttcccacctaagagttaaaaccaaaaccttctggcttacaagggcttacacaatctcctactgttcttgtttagtctgctttagctacactggcctccttgctattctcgtgaacactccaagcatgccctgtctcagagcctttgcacttggctctccttgaaatgctcttccttgagatacctgtaaaactagcttccatcctcacttgttccaagtcttggtcacttttcctagcctcctatataaaatttcaaatactatcctccaccccaacacattccctttcctgttaggttttttctcactactaatcaccatccaacgtagtatcttgtccattttgtgtctttccccactagaatacaggctccatgaagaaaggatttttgtttcccttgctcactgctatatccccagcacccacagcaatatctactatgaattaggtgcacattaagtat

SEQ ID NO: 15732 - DNA, 1177 bp, Homo sapiens
ccataaaattgttcatttctgttaatggtctaatctctgcagcgtctctatttaggcctcatttttccatttctaatactgtttgtgtctttttttaaaattttggcagaactttaatcatttcaagttttattaatcttaatggatgttttcaaagaaccaatttctagattagtttatcctttctgtgctttgattctggattccattgattttgctcttgtgattttcttccttctgctttctttagatctatttttaactttttataattttaaaagagttgatggaaattcaatttattgaatttgatagtttattcttggaacatttaagtgtcacttttgtatctcttgcatcatcttaaaagtttatatttgatttattaatgaattagtgatatattatttttctaaatgccgttgatgacctttaacattaaaacaaattttaaaagcatagtatatccatatgcattttatcagaaatccctaaatcaaagaaatgtaacccatttaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaagtatgagaacttgtaatgctgcatgttttcatgtaattaggggaaatatttgaggaactgtccatttttttaaacaatagaaatatggtcaaggtattaattgttgttaatatttttatcctccaggtccatgttgtgaatatggtgaaaccttattattaaagcctcttttagaaattaggatctaattcactttatataggttagatttaagacttggcttacttaatatgtcaaagtctgctttgtagtaaagtaacataaaaaatacagtaatgattaaagatttaagaagtgtgaaaataacttgaaatttattggtaacatttttcctatttatttttagaatatagcattcctaggtcagtggcctttttttaaatccagaatggaaaagaactacatttctgaaaacaatgtatggatttctgttttagatagcatttatgggaaggcatcattaagattcttcaaatgcaatgattatatactgttactga

SEQ ID NO: 15733 - DNA, 1148 bp, Homo sapiens
ccaaatatattatggaagccctattttacggtctgaaccaactgtatgaatcatgagtctaaatgttgtcttcctttcctgttaagtagtatgcccaggtatatgttcttggatagcttgccagatgactggtggagtatacaggtgtgaatatagaggaaagtaaactgagaaagtaggaataagtatgatcttggatgtggaaactcagagtaagaattaaattctggctgtactgatctcaggaatgtagagacctcagaatatggagaatgtctgtctcatttaggggaataaacaaatactaatgaaatttgaaattggtagagaaaatgttatatttcaaattttaatttataaactttaattcttcttttagatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataatttatacaagggtttttttttcttgacttttctataggggtcatattcattaaaaagcccaaaaggctacctttgccttaacccttctgtagtacaggaatgattcttagatttgtttccttttgttatagaagcaaatattgtttttttaaaatagcctgagatgagaggttatattgta

SEQ ID NO: 15734 - DNA, 1205 bp, Homo sapiens
ataatgcgcgcttactatcttaaattaaattccataattttcagctctgtattttttccaaattaaacattatatctcaaacagacccagatatatttgaatattattaatgacaaacgttaggcttaaattacaaataataatatacctaacattggaaatttccatcattcctagtttgtcagactcctttatcttgctaatttgcagatattgctttagtaatgttgccgtgattaatgaaggttttcttggtattaaaagatccaaagagataggaatatgtaattgaactctagattgttgatattctactttcagcattctgaagtcatggaaattcttactgtagaaactcaataaacttacaagtagacctttactttttagttcattactgataaaataatgaatatagtctcatgaaggtgagttttcagaaaatagaagcatgagttgtgaagataatatttttaaaatttctctaatttgttttgttttgcaggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaaggtgagtcaaactaaatatgattgattaattaagtagagtaaagtattctaatcagtgttattttgttactccctactgcttactatgctctaagaatgtgtttataaccattcctcaaagcaatctttttcatgcttattcagtaaattagaaacttacagaaagtagcaaagccagttcttggactcaaaaactgataattaactttaacagactttttcagttttcaggccattgtcttcacactgttcttccttcctccccactttcctccttcccttagttattttcttctttcttttctctcactttcactctctctccactccttccttccttctttccttccttccttctttccttcttttctttccttttttccttccttcccttcttccttcttttctttttctttcttttctttctttctttctttctttctttctttctttcttgctttcttgctttcttgctttcttgctttcttgctttcttg

SEQ ID NO: 15735 - DNA, 1201 bp, Homo sapiens
tcaatttctttgtcactttatccagctctccacaaaatatcactaaaagtagttattgtaacctagtaatctcttaaaatttgattctgtttagaagccaagtattgacagctattcgaagagtgggcacaaaccagataatattaagggaaatttggaattcagaaatgttcacttcagttacccatctcgaaaagaagttaaggtacagtgataaatgattaatcaacaattaatctattgaatgaagagtttctgatgttttcttgtagagattataaaaaagtgcatgtatatttaaacctagtgaacagtcagttcctatatcctgtgtctgtgaattgccttgaagtttttttctcactcgtcctggtagatcttgaagggtctgaacctgaaggtgcagagtgggcagacggtggccctggttggaaacagtggctgtgggaagagcacaacagtccagctgatgcagaggctctatgaccccacagaggggatggtgagatgacccatgcgagctagaccctgcggtgatcagcagtcacattgcacatctttctgatgttgccctttcaattacaaatgtatgaaagtcacacttactttttattccaggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcatgtaagttgtccttgccctttgcctttctagaggtgcaaaaaataaaatgcaggcctactatgcaggaagttaggaaactactataaatcggaagaagggaaatcctaagaagggaaagtaagattacttcagatttgaaagctctagcagtatcaactggtcgtagatacatttttaaaaactgaggttggttattgtgttaaataagatttaaagaactggacctgtattacttgtgagacttgggctgtgtataggattccttaccaatttaaaatatgagctgagatagcttgtccttatgctaaatcattctgggttttctgtggtagaaatttgacaccctggttggagagagaggggcccagttgagtggtgg

SEQ ID NO: 15736 - DNA, 1117 bp, Homo sapiens
aacagtgtcacttcagggacaaaggcctggaagcccttaaaataagttatcttagatgtgccagaacatattcagagctttattcctttaagcttaaggcttcaatacttgtagaaatgcaaatattcttgagaaatgatacattttttgttctcaatttctcaattctacatacctgattatgagtgaagtatccaaagcaggttttcatcagcatgggggatggaaggtaggtataatatgaggacaatggaaactttgggagaagggagtgaggaaatggataaagagaaatttgaaaattttaggctggacttgagcactattgctgctttcctatgaactatcagaatgtttaaatgctttatcattcatggtccactctcaaccaacatttattatcctttagtaattaaacaatggttttacatacatttttataatgtagaaggaaattcaagattccataatcgtaaaatttttcagatttgtctaatgtgtaatttgtgcatcttcacatgctgctaaatgcagatttaaacattacatctgaggatcatgacttttcctcctttcttggagatcttggtataaaattcatctgctgttataaaatcaggtttctacagagttcgtttcacactaaaggtagtttgttactgtttgcatgaggaaaccatgtatgtctcaatctttaattttaggtggtagtgtttattgttcaccctccctcttgcctccaaaagaatgctgaattatacgccaatatttccatgtgtattctgttgccttgatgcgtactatacttgttgcatgtatattaaaaattttgtactatgcattggtggtcttattttgcttgacaaaaagttacctgatttaagtacacttaacttttgtttcagcaaatgtggtaaatatatattatttcacacctaaaatactaacatgaaaatggaatgggagaaatccttatttcaactcacatcaagttaaatatcctattttttaaaagtaacatgatatgctttagaatacacaacatctattcaatcaatcagtacagtttagtagtggttctggcagtgttactgatttaattataaaatagtcatgt

SEQ ID NO: 15737 - DNA, 1198 bp, Homo sapiens
gtaacattaagcaagtcacctctcttcactttttatcctgcagaaaatgtagatagtatcatgaggctgttccatagattaagttaattaacatatataaagtatttaagaatagtatccagcacatgctgctgttgtgctgttataggagctcttatacttcctcagagatctaggttcagaaaaatacagtataaaaaccaccaatttacgaaataattgcatcaaattgaaattttttactgtgcttggcatatgaaacagtttatggtttttatgacctagttgaaaataccttggtggcatgtgcctatagtcccagctgttcagaaggccaaggcgggaggatcacttgagaacagggggttgaggctgcagtgagctatgattgtgccactgcactctagcctggataacacagtgagaccgtgtttcttaaaacaaatttataaataaaaatactttgttctcttctagcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtaagtctcttaaatatgctttgagactcagaagggctatatcctgaagatctcctggtttttaatagcaaggtggcagtagagtttacttatgtagaacatttgcaaagccacatgatgtgtggctctctagtcctcaataaagttgctgtcttttaggaaggtgggtttttcctaatagttcttgtgtaatcatactctgattgcttaggtatacccttgtatttagggatggcgtgtagtttttagaataatttacaactaaaaagttaagagcagatcattctttgaagaagaaatagaaacctttttaattttcagagcaggggtcagcaaactctggcccatgggccaaatctagtctgttgccttttttgtacaacctgcaggttaagcatggtttttacattttcaaatagttgtgtaaaaatatcaaaagaatattttgtgacaagtagaaattttatgacattcagatttcattgtcataatgttttattggaacacagccatacctgtttgtttaggtataatctgtagt

SEQ ID NO: 15738 - DNA, 1418 bp, Homo sapiens
caacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggggaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccagg

SEQ ID NO: 15739 - DNA, 1181 bp, Homo sapiens
cctgaacataaaataaaagtttaaaaaatggtgacttttatagtagcattgacatggccccatatgaataaattgtgaatatatattttcaatgcttaccgaggttttaaaaaacatttctaaataatatatgcaggtttgctatattgaatagtgatatacaatagtttagtcattctcaaatgtaattggtacatatgcaatctttttgggtcagccaacttatcaaattacatactagtaataatgccttacttaccttttgcttggtagcccaggtgaaatgataaacctgtttcaattcaggccccagttatagtaattacattcaaatcctaaactttatcaatttctccaaaaggaattagatcaaaagattcaatagctttctctgagattgaactggcttatgctactggtctttaataagtaataaatagaatagaggaagcaatattgcctgcttttaagtttttgagcatattttcaaaatgaaggtgaattaatagattcattttttgctctcaatttgtttttagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtaagtatccagtaccttgtcagaatctatttcttttatatcacagaaatagacaggaccctaaactatttatttttcttaattatggaaaaaaatgatttttcatatttctagttggtatataaatactaattcaattatagttatttgaatatttctgttgtataatctgagaaagcctggggataaggaaatgaataatctttctaaccaaattctcccatccttcttttctgtgttactatgatctcatataatataatgccaactttttacaagtgaactaggagataaattttaacaaactataatgggattttaagaaagagaataaaaattggatgtgatggccacagtatttaaaaacgatgtggtctgggcactgacaaatctcaacagacttgtcagattgtacacactgctgtagccacaccagcgtgtacaagctgaggataagtcctagaaataaaaac

SEQ ID NO: 15740 - DNA, 1197 bp, Homo sapiens
ttttaatccataggaaaataagattctattttaaaagacccttctttaaaaccaaagtttgatagctgttataatggcagatctgtcattccaaaagaaagctagctaccctagtgaggctggagattgatgggctcaatcacatggtctgctctgaagtatacttctgatttcctcatttgctgtgtgttcttaagaggaatggaatctgcagacaggttttcagatatactctcttaaatttgatcctctcccatagtatccatggacaaaatccatatcatcttcatatgtaatcaatttgattacatatcatgcccaaactgaagggccgagttagaaggcagcattttatactgtgtgtttatgtcttctgtaatggacctctcttttgaaagtctttgaaatgtttggaaagcaatttaatgatccaaaattacataatgtaaaacagcatttttcatgacaggaagggatgtgattgttgatatgaccataaagcgatccatcaggccaaggtttgggtgagtgttgggcagtgttgccacatagctcaagccaagaacagaagggcagacagattgaaagatgtagcaaataaagtgactttttaccaagatcactgtaacgtgcactgaatgtttcctggtactgagtgtacaaaaggctaatgctataaggtttattttgactataaaagagtttatagatttgaatataaggtgcctcatgtaaatatgcttcctagttacaggtacacaaactctaatttgaaagaatccacaaatggctagctgagaagttaacagatctctatcattcgtctgtgtgtctttcttccctcacctatttttacatgaaattattatttcaaatgaaaatcatgatcatgtgccttttgggagacatggtttctctagaggtatatagtttgtaattacccgccttggtaataaccttcctgtggaactgactaaaaatttttgttttatttgtagagattatgatttgaggtatacagtaactttaatgttctattcttggaatctactctatctcccatgtttaaacattcttagagccatttgtgggattcattgacaaatttatagtctcaagggagagtttcaagaagtatctatatgtatactcatggttggggttctagaggcattacatctaaatatttatgacttt

SEQ ID NO: 15741 - DNA, 1573 bp, Homo sapiens
tacataatttaatcctgtctattgtcccagatctcttgtggctactttacctgttaccttttttgggattttgttctttatgttttacagttaccttcggaccagaagatatatggtatttttattcacttttttcagtgttttaaaataaggtttgttcatttattcattttatccattcatttcctattgtcgtatagttctaaccatatatatagtactttaaatattttcttatgttattatttaacacaataataaattcttatctaaagaaaagattattttactttattttacttaaaggaaagagaatttattggcaggatattgagtagcttgtagagtatatggaaggggagagccaagttaggaactggcaggagcgaggagggacaagacagctgcctgcacagtctgataggacacatctggctgctgccactggatgcccacatgggcagcgtgttgtaaatatcaccctaccagttggtaagttggcatgaattttccatgaaacacttgactgccatttgcagcatcatatctactttttatgcacctaattatatttttcctttcacttttatgtttttttctaaaactgccacctaaatacctttccactccgttaaatgtatggagtcaagataaatttctcattcttgctctacagtttaagatgtataagaagtaaacacttccgtggaatagggcttaatttggggctcaaatgttttgttttcctcctgagatgtttttgaatggataagactactctggttttggatgcagcaacttttctcctggcatggaagaactaaggactttgataaacagtttcccattgatagtataatataatgaggggcccagtctgctcttgtgaaaattggctgagcggcagcagcccatcccagctgtgtgtgagtagccccgctgttaaaagtacacctgctgggaattgttggcacatgctcatagcatatgctctgtgggggaggtgcttttaattccaagaggagcttttctcccacatctgcggatgcagaacaaagatgcagcaggactttagaaaacaggagtgtttctactgacattttattcattgctttgttagtcccgcaaatggagcaacttctggttgtttgtaagcagaaaaacaaaacattcaaaaccaaaaacctaattagtacttttgtcctttatatccctaggatgctctagggagtagaggtggcaggcatctttatcttcacccactggcacattagcagcttatgcaacttaggaagtcactgggagatgagtcctaaaagcctgaatttcaggatggggaggagataagaagcagagaactttgggagaccatggggcatttagtcctggcatagacacagaatggatattcacaggaagattcctgaggccagatatgcaggagagcacacattgtcacaaggggtgtggtgggaagagaggtgctggatgcctaagacagacttctgtgcttggcagattgactgagtgttgactctgaatactttgtggtccagtccataataggccagtc

SEQ ID NO: 15742 - DNA, 6474 bp, Homo sapiens
ctggagtcttagctacttgggagactgaggtgggaacatagcttgagcccaggagtttgaggctacagtgatctatggtcacaccactgcactccagcctgggtgacagagcaagatcctgtctctaaaataataataataaataaataaacaaatgttaaactaatctgtaaaattcctagattattagattaatagtaaatatgggactctaatatctgataacaaaattttaattcttaatactgtacattaattttactcttatacttggcttttcaaagatgtagtggtaatcataagttaggaactgtttatatttgaaatatcttaaaaattttgggatgtaattgaacttgcggttttcatacattttcctttttcattaaccatttaactttgtattagatatcagtagctgatcttccgggtttaatagaaggagcacatatgaacaaaggaatgggccacaaattcctcaagcatatagaaagaactagacaactactttttgttgtaagtcatatgtatactaatgtgatattcaaataaattgaaaaccagtgaatttagtttttctagaatttttttataaataagaaagtggtagcatatgttactccactaagtcttttataatatggggatggaagtgacattgtttactatatcatatgtaagtttggccatacttgccaacatgtatttccttaagatttccagcatactaccatattatatagtatcatagtatctctttcattcttcactgatgatgctagagttatatatgagattgtcttcatacaaattgtcttatcctagttttttattttattaataactgtaattttatcagaataattaaagttatcttaacacctcgatttctgttacttattttgaattactaagtaacaagtagagtatagagaaattgtttttagcttgagagagtaaaacattttaaaacatagaaatgtatagctattcttcgtatgttaaaggctgtctctttccttctcttttttttaggttgatatttctggatttcagctttcttctcacactcaatacaggacagcttttgaaaccataatactgcttacaaaagtaggttttctgttttactgtgttctgtatttggtctaatacataggaatgtaagactatatgaaataacataattacagtctatacatactccacctttaaagctttgatgtcagttaaagaattacttaaacttgttgtctccatttcctctacattcatttgctcctcaaactactgcagtggataaaacactcctgggcttccaaatccccattacatacttcccaggtttttatcttgcttcagctttggcacattgtttaattcctcttgtttctcattcttagttttgtgaccggtaatcttctggttctatttctactcttacactatttctccgtctactttttaggctcttttttctcatcctttaagtaacattattcagagttctgtcctaaccttattttctatcttactcactcccgttgctttagttacaattaataatattgatgactgccagatctgtagctgatacctaaatcttttcattgttctttctttttttttgagacagagtcttgctctgtctgccaggctgtagtgcagtggcatgatctcggctctctctgtctcccgggctcaagtgattctcctgcctcagcctcccgagtagctgggattacaagcgtgtgccaccacgcccggctaatttttgtatttttagtagagacagggtttcaccatgttggccaggctggtctcaaacacctgaccacaggtaatccacccaccttggcctcccagagtgttgggattacaggtgtgggccattgcacctggcctttgttgttctttagaccagatgcccatcggacatcttctttgactagatgtcccattagtcacttaaacttaatatggataaaagtaaacttttaaaaaacttttcggccatccccataacttagtgaatgtgtaagctatgatatactgattcttctcaccacctacacaagccctgtcagttttttatcctaaatctctctgaaatccatcctcttgtctttatctacgctgttataatcatcagcccttcttattggaatattgaatctggtcctttccattctccctgtgtcctgccttgcttctctccagtccattttttatatggcagctagagtgatctttgtaaaagcaccaagctgatgctgatgttccctgcctaaaacactttgatagacccccatagctgttaggttaaagtctaacctgagcatgatttatgaaatctgcaagtttaggcccctacctagcagtcctcctctgtaaccctctcccctagatgctatatttcagccatgtgatttctctctaagacaacatggtattgccttacctccaggattttatagatcctatttcatttgccactttttgtctataatgaataatactgctgtgaacatttgtatgcaggtttttgtatagacatgttttcatttctcttggatgtatacttaggagtggaattgctggatcagataataatgctttgtttaacattttgaggaactgccaaactattctgaattggtagcaccattgtgccattttacagtcccaccatcaatgtatgttccaatttttccacatgaatgtcaacacttgttattgtctgtcgtttttactttagtcatcctagtgggagtgcagtggtattttgttatagttcttatttgcatttctcttaagactaatgatgctaagaatctttttatgtgcttattaggcatttctgtgtctttggagaaaagtctgttcagattctgtgtgcattactatttgtattatttgtcttttaattgttgagttataagcatgttttgtatttttggaaataagtcccttctcttttttttttttttttttttttgagatggagtctcactctgtcgcctgggctggagtgcggtggcacagtctcggcttaatgcaacccccacctcccaagttcaagtgattctccagcctcagcctccccagtagctgggattacaggcatgtgccaccacgcccatctaatttttgtatttttagtagaaacagggtttcaccatgttggccaggctggtcttgaactcctgacctcaggtgatccgcccacctggcttcccagagtgctgggattacagacgtgagccaccatgcccagctggaaattaagtcccttctaagatacataatttgaaaatattttctccccttctgtgacttgtcttttcactttttcagtgtattttttctgtattctttgtggcacaaaactattatttatttatttaattttccagttttattaaagtgtaattgacataaaaattgtgtgtacttaaagtgtacaagtgatatttggatatatgtttaccttgtgaaatgattgaatcaagctaattaacatgatccatcatcttacatactattttatgtgtgttgagaatatttaaaatctgttttagcaattttcaaatatataatacattaactatagtcatcatactgtaaaatagatcttcagggcttattcatcctatttaattgaatctttgttccatttgaccaacacccctccatcttcctcccccaagcaccctggcaaccaccattttctctgctactatgaattcaaccttttaagattccacatataagtgggattatgcagtatttttttttctgtgcttggcttatttcacttagcatagtgttctccaggttcatccatgttgttataaacgacaagattttctttttttaaggctgaataatattcagttgtgtgtgtgtataccacattttcgttattcatccattgatggacactgaggttgattccatgtctcggctattgtgaataatgtttcagtaaaaatgggaatgcagagatctctttgacatactgattttatttcctttggatatatacccagaagtgggattgccggatcatatggtagttctatttttaattttttgagaaatctttatactgctttttacaatggctgtactaatttacattcccactcaacggtgttcaagagttcctctttctccatatccttgacaacacttgttatcttttgtctttttgataatagccatccttccaagtgtgaggagctatctcattgtggtttttcttttcatttccctaatgatcagtgatgttgaacattttttcatacatatattggtcatttgtttgttgttgagaaatgtcaattcaggttctttatccatttttaaatcaggtttatattacccaaagtgatctacggattcagcacaatccatatcaaaattctaatggcatttttcacagaaatagaaaacaaatcttaaaatttgtatggaacatcaaaagaccctgaatagccaaagcaatcttatcttgagcaaaaggaacaaagctggaagcttcacactacctaatttcaaaacctactacaaagctatcataatcaaaacagcgtggtactggcataacagtagacacataaaccaatggaacagaatccagagctcagaattaaatccatgcatttacagttaattttcgacaaaggtacctagaacacacagtaaggaaaggacagttttcttcgtcaataagtgatactgagaaaactgaatatccacatgcagagaaatgaaattagatccttacttcacaccatataaaaaatcagttcaaagttgattaaagacttaaagcctgaaaccataaaaccactagaagaaaacagagaagttccatgacatttgtctgagcaatgatttttttttaatgtgaccccaaagcacaggcaacaaaaagaaaaatagacaagtaggattgcatcaaactaaaaagcttctgcacagcaaaaggaacagtcagcagagtgaagaggcaaccaagggaatgggagaaaatatttgtaaatcatatatctgataagtggttgatatccaaaacataaggaagcaaaacaactctcaatagcaagaaaacaactcaaaatttttaattttcatgaaattccatttgtttcattcttttctttccttttttaaaattaaactaaaattttgtatagagatggggtctcgttatgttgtcaaggcttgtcttgaactcctgggcccaagcaatgctcctacctcagcctcctaaagtgctgagattacaggcatgagccaccatgcccagtcttacatatttatttatttttattacaaacagggcttcgctctgtcatgtaggctagagtgcagacatgatcctagctcattgtagcctcaaactcctggtggccttaagcagtcttctgccttttatctattattttacttgtgcttttcatgttatatctaagaaacagttgtttaatccaaggtaacaaagatttattcctaagtgcatttactttttccaagaatactacaggtataacattcagtgatcattactgacttctgaattttatctgtgtgaagtccagatacccatatttgactctagacgcaaaattacaactgtctctaggatatcatttaagctaaaacatactaacacatgacttaaccagagtcattttctgaaattcttccttttgttttctgttgttgggatttattgcatttcggtgatgtgaatgggttttagatcacctgggtcattaattaccaaataagtagtttatacagaaaccagtactaaaattattgggttttctcttttgatttaaaggagttggaattgtacaaagaggaacttcagacaaaacctgcactcttggcagttaataaaatggacttgccagatgcccaagataagttccatgaattgatgagccagctccagaatcctaaaggtaaacctatttattcatttaattctaatttaaagaataattacaatgtacagagaatgctgttataatcagtggaaaactgacagtttctgctcttaaaagtcaagtttgaagaaagaatatacaaaacatgtaaataacattgtaacataataattaccaaattctagaatgtttgatatggacagtaaattaaaggagacaaaagaaagattaatttgaactaaaaaggtcaggctacatgaagaataaaacttaaattgggcccataaggcatatgtgggatttgaataaaaggaggaaaaagtcagcatctacctgtgaagtctttcactttcattaacatacttcacaagctcttcattcgtctagtactgtacatcataaaattaaagacagaactaagaagttctaaagaagtatgtttcttggcaaaagtaactctataggtttctgaagaggatgagtcttctgaaaagaacttcatttttcc

SEQ ID NO: 15743 - DNA, 2318 bp, Homo sapiens
atgttgaagattactttcttttgtgactttcttctacctcatgccactgtttaaaagtaaaacgtattttaacgatgttagaataagactaccattctaaatatcacctacttatgaataacatgtaataatttttaacattaatgattccataaattgtattattgggattagaatgtgctttatgacaggttagtgtttcctctgaggcagaaaactcttttttggagatatcttccatcaagcagtactcgtgcccatatacaatctcttagtggctaggagaaataaataaaagggccataatggtttgttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaattttgagattaatgttaattttccctttttgttaatttcagtcccctctcactatgcttttgtccagaaggatcaagaattctaccatcccttgggtctttgtgtataaacaatgttaaataaaggtagactcagtctttaagatattagacagtttttttagtccatgggattgtaaatataaacattaactttcctataagaatattttggctttgtaatctatagcctcaaattggtatttattatggattcactagacaaacagctgtttccttattgtcttttttctttagtgtttctgatttgctatcagtagctgtttttaaagccgtccaaggaaaataattatttacagtttttgaagtcacttttgagccctcatcaagctctcattgtgatgggagggatacctttttgttgttaaaagcctattattgttaaaggccttttatggaaaccaacttggaaaacaaccttaaatgtggatgtatcagatttggtttatccagccatgggagagaaaacaaacctaagtttactttacttgtacatatacactacaatggatagtatatttgctgtaaactacaatgtaaaacctcaataaaagtgcgctgtacttcttaatgtttattaaaagatgtatttttacaagtttctgcttctgtttttttcctcagtgttttaaggtgaaatattttgagaaatgtttctcagatatatgtaaattgaaaaagacagttccatttaaagctctaaaacgtgtgaactggaaggctgggtgcagtggctcacgcctgtaatcccagcactttggggggccaaggcaggcggatcacttgaggtcaggcccttgagatcatcctggccaacgtggtgaaaccctgtctctactaaaaatacaaaaaattagccaggcatggtggtgtgcacctgtaatcccag

SEQ ID NO: 15744 - DNA, 1244 bp, Homo sapiens
aggtctttatttgagttaatttttttatatggtgtaaggaaggactcgcattctttttttttttttttttttttttttttcaactggggccttgttctgttgcccagactggagtgcaatggtgtgatcatggcttactgcagccttggtcttctgggcccaagcaatcttcatgcctcagcctcctgagtagctaggaccacagatgcgtgccaccgtgcctggctattttttttttgtttatttatttttttttacaatttttattagagacggggtctcactgtgttgctcacactggactcaaatgatccctgctgcttggcctcccatgcttaggattacaggcatgagccagtgtgcctggcctcacacacttaaaagtagaattttagcttcagttttcagggtgatctagaaatattgctgttttctctttgcctgcatccacttgtgtacctcatctgccatcccatctcctcctcctccattcttaactaaccatgacataatttattagaatctgtttgcgtagtaggtagtagtgcaatcagagtctatgaaaggacaaagtctctattaccaacataattacattcaattaagcaaacaaccaagttgtaatggatatctgctgtttctgccttctgtgccccctctatttttctggacgtgggacttggtttgctctttgtgaaactccctacccacagtttagtctacagactgaccttgctcaaggagtgggcaaattgcagtgatttggccaatgaggattgtgtctctggagctacagtggttgtttcagagatgtacacagacccaaaaagggtcatgagagagatacctataattagtgagaaagaaaactgctgtagcctggaatattgctgccttaccaccagaaagtggtgtctatttatagaaccaacatgaagaaacgtgagccaagagatggagagagacagattcttaactatcaattaaacagctggatctagctgtgcctgaagcttagactatttctggaccttttagatacatgagcctgtacattcctttttaggtttgcagctgaaatagttgtgactgttatacagatctagtggttggaactgagaacacaagatataagaagatattttctgcttttgtggacttgacaacctaaaagtgagacagacagacatgagtaaatgaataaatgacaaatgcaagaattgatatagaatagattgacagca

SEQ ID NO: 15745 - DNA, 1220 bp, Homo sapiens
aatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacaggtatgtttacttcttcatatatggtaaagcacaatgaaaaaaatgtacatttcacactaaggtttcaccttcatagaacataagttcatatccttacaagagaatgaaaatgaaccctctgatgtaattttaacttgagcctatcatttatttatcatttaagtacttttttttttaaaccattgttgcctttctttcagttaatctatcttgtatattctgctcaggaaataaaacactaatggattcagattttctttggaaagacaagagtttgtataactttatggagaatctcagcattagaaaagttattaatttcattttgtaatttttgttataatctcaaagattggtttcagcgtttttatttcatagtgatgttttcaagtctctacaactgaa

SEQ ID NO: 15746 - DNA, 1540 bp, Homo sapiens
tttccagcaaatggaccttcaaacagaaatacattagagcaactcttttcaaacaccattattgtatagcatttgcaagtgggtatcatagagttgtcattatatttacccagggttgccacagtgcctacataaaccagaatgctgttacatttctccaccgataaaagaaaatttatatatcagcacttagtactcttaccagtatctgtgaggtatggatgacatcctgaaaccatcctatagattaaggaaagattagaaataaagactttttaggaacccagcaccagcttcatgtacctgttgaaatggttagaagaaagtcttgataagaaacccaagatttggtgttacctttggactgtcctttgctagattctttcttccttttgaaaaagtgagttgaaatattacacaatgtgtatggatccagagattaggtcctgatatgccagagctgtcttcgtaactctgtcttccttcagctgtgtggattcagctcttctttccgtttctttttttttttttttttttttgagacagagtcttgctctgtcgcccaggctggagtgcagtggcgcagtctgggctcactgcaacctctgtctcccgggttcaagcaattctcctgcctcagcctctcaactagctgggactacaggtgcatgccaccatgcccagctaatttttgtatttttagtagagacaggattttaccctgttagccaggctggtcttgaattcctgacctcaggtgatctccctggtttggcctcccaaagtgctaggattacaggcgtgagccaccatgcccggcctcttctttctatttcttcccatcacattgctgaactccattgtctcttgttttttcaatttctttttccttgtaggagagggaaatgaggaaatcaaaagaggggaaaagttttgtgagatggagaaacataggatgtggactcctggctcacaagatcaagcccacagttcactaccattccacactcaagcacttctcccatagaggcagacctaaaatgccagtttttgtaatttttgagagaattctgtttgttaaatttcatgtggagaaatgaaaagaaattatcccatttatggaaggtttgcctaattataagttggccagtagtgtgtttctaggtacagagaaaagcttgatttggaattgcaaataaaactgatttttaaacaccttagctgagttcaaagatagttttaaaaattgtttttagtaaattaagagctgaaataatactgaattttaaaccttgctttcaaattcactcttttcaaacttggtggaaggatttttcaaattaacttcactcttggttaagctctcagtcacggctattttatttctgcatatggatctttatagagaagaattaggtaacattttcttggtctgataaaagtgtttatcaaattatgctttttaaaaaacaattatttcacaagcttgtttcacttaaccatttagggagggattttgctgttctgctggtaagaccta

SEQ ID NO: 15747 - DNA, 1146 bp, Homo sapiens
gacagggtctcactgtcactgaggctggagtacagtggcatggtctcaactcattgcaacctccacctcccgggctcaagcaatccccccacctcagcctcctgagtcgatgggactacaggcacatgccagcacgcccagctaatttttgtatttttagtagagacagagtttcaccatgttgcccaggctggtcttgaactcctggccttaagcagtcctccctcccacctcagcctcccaaagtgctgggattacaggtgtgagccaccatgcctggactgcattaccaactcttgggactataatttttcatgtttcctttgaagtaatctccttaactacaaatcagttcttatcaacaaatatttataaaccaaatatgagttgcttgattatgtttcaaatattaatcatgttctgtgtagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggtgtgccaggcttccttattaaaaacatgtaacaaggagtgggagtaattttgtcataaacactgtgcaaatatagagaaatgtaacatgcatgatatttaaatagcatgcaactgttttttttaggaaaaactataatagaaaaaactctaaatgtttccaaatgatgaacttatgatcgtgattatagcatattctctactgtgacttcagttctgtgtgagacttgtatgaaatagaattttgactttgacctttattttaccatcaaccaatttgaagtgatatttatgaacgcagtagaattcatgattgagtgagctaaaatatgcaaaatatttgaagagacaatgcttgttaaaagaatatatttcttggtataaatactgagatattctgttgccaaagacacattacaactagtcatttttatattgaacattagcttcacacacaaatagatatggtgattcccatgttcagtaaaagacaaaaatt

SEQ ID NO: 15748 - DNA, 1515 bp, Homo sapiens
aactagattaccatcttatgattcaaactttccatatatttaacccagatatatattttcagaaaaagtaattggaaaagttatgtgatcagtcaagtactgttttcctaaaatgtggtattgaaaatctcctggaatttttaataattcatgttgttttatgtgaaaagaatgtcatctttttattatattatctgtacatttgctgttcatctaaaatgtagataatatcaccccaggctaaaaaggatgagaaagaatttaaactgattcttataactttttcttttttttagggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttg

SEQ ID NO: 15749 - DNA, 1134 bp, Homo sapiens
tgtatgcaacaaatagatcagagcaataaaagaagaattaaaaattagtgtggaatgcttaatacacccttaggcatctgtataattgacattaatctgtaaattaccactgtgttttcttttcctgtccattcctcacctgttatatttctcatcttccttttttcttccttttcccttcctttccctcccttttaattagcaagtagtataaagatatttacatttatttttcttagtattgttattctagaatagagttttttaaaactaagaattagtcattcaagctgttgtaaaccagaccctcagtataaattggattatcagcttagaagtagagtttatcttttaaaagtgttatcttcaatgtatttcaaggtagaaaataagtgattttcatcctttatttttccctttctttccattttaggacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagaggtaaattttttttttttttaatattctgcattgtaaaatttgtatccaggtgatatgtaactgtcaggtttttttttttttgattgtcttagtaatttggtcattttttttctcttttgtcttctaaaagacccttttaaataaagggcctcttttttttttttttttttttttttgagacagagtcttgctctgttgccaggctggagtgcagtggtgtgatcttggctcactacaacctctgcctcccaggttgaagagattctcctgcctcagcctccccagtagctgggactacaggcacgcgccacaattagcccagctaatttttgtatttttgtataatttaatttccaaaaatttccaaaattagcccagctaatttttgtatttttagtagaga

SEQ ID NO: 15750 - DNA, 2194 bp, Homo sapiens
atgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcagtaaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatca

SEQ ID NO: 15751 - DNA, 1097 bp, Homo sapiens
tggaggtctttgcaattcatagcatagttacttcagaagagacattgaaatttgaattactcacttatttaactggcaactatccatttaggttaggcaaaggcacggtaacatgttgcgcaggatgttttactgaatttcttaataatcgtgggatttactataactcatgaaaactccactttttttctattttataaaacacgattaaaagtaattgcacccatcagtaattagaatgcactgtaaaattgtgaaaacaaataactatgattgcacttccaataaagtgtctcttaaaatacagcaccgctgttgctaatcaactgtattttaatattaaaataaactgtttttaacagcagcattaggtttagttaacttaagctacaggctacatttatataaatgcagtctccatggcaacaaaaacccatttaattctggaatatcattgctaccaagtggcaccttttactcccgagaacgctgacactgccctggagcactctaggatgctgcacacctaaatgccttgttagtcagcacacaagtaagagtttggcacaattggactgtaaatagacatgaaaggaaacctttgattcatgtgaaaattaaaactaattacactatggtagatgtggtactaaagagacttcaattcacattgctcagacaaaaaggaagtaagttatggaagagcacaaagagattgaggacatatatgttatcggatttatccaaaataaatttctagaatgaagaaaactttttttttttttttaaaggaaagccacccaaagattagggagtaagcctttagtttaaatgttcaatttaagtattgtcaagcctaggctaaatagaggactgcattttcttagagtgtggaatacaacttatttatttcatttttgtttctctttctcttgctcttctttttgtcagcaaaaaggggaaaagctattcaattaagtacaaaggaaattccctgtaaggttaaaataaaaaatgaagctaccattcaagggaacttctctgtattcaaccctaatgtcagtggtttatcactgagttggaattaagtgaatcaa

SEQ ID NO: 15752 - DNA, 1122 bp, Homo sapiens
gttactaaaattaaatgagtccattatgaataattcaaatataatcaaatgaactggttaatgaaaactcaattttgacttctgtacttctgacattttggggttttttaatgcatagctacgacacatattttttgaattagcttttaaatattcaaaatatttttattttaaacacgaactttaaaggtttaagtgtaatactatgtcacttgtaatagtagctgtacttccaaaacagaatctgttacttacagctcagcaaaattcttccagtcatcttcactaatggatggtcttgtgtgaccaagtgcagtcattaaatgtgactgactaatagccagtctggttttgattggtcctggttggttcatggattcgtcctccttaagtaaaaaaagaaattgacgaagagttaaattaaggatgtaaaaaaaaatgtggtagtccagttgttacttcttattgtcagttttttcaagagaccatacgttctcttccttataagataatgaaacattgaaagcaaggaagcacataaccatgactgagttaatgtgttctggtcccttgtttataaatatagctcgtttataagtcaaagaaatatatatcaaaagggtgaaacaatttttaagaagttttaacaattataatgagggggaaaaagccatactccactttggctccggtatctgcctttgataatactgatatctgccctcagttgatctctttgttcttgtgtaagttcttggcaaccctcttgtgaagctgtccttaacactggaggctgtgaaaacaactggtctttcccaggaactccaggcaaatcctgagtcatggagcttggtgcagagagacattgtgagctctgcatggtaaattgtagtaatgaaagatggaaggaagagggggagagaaaaaactatctgtttaccaaatataaaaattaaacattttaagcaataaaacattaacatagataagtatacatgttaattaactgaaattaagcaagctgaaaagttgttcatcttttataaaggttcactgatacctgtgttatagaaccaccatcaagtgaaaattgccataacacagggtaggtttttttaactt

SEQ ID NO: 15753 - DNA, 1158 bp, Homo sapiens
cagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatca

SEQ ID NO: 15754 - DNA, 1158 bp, Homo sapiens; identical to SEQ ID NO: 15753

SEQ ID NO: 15755 - DNA, 1113 bp, Homo sapiens
tttaattgttttgtgcttggtcaagtattcatcttcttcttcatcaagctctgattcttccagcagttcttctgattctgaagatgaggtaaggtttgcttataatggttcatgaaataatatctcttaatttctttaatgtcaagtggaaacccattgtgaaatatctgttagaaatgttgacttccaggttttgattaattatccataacttagaggactaacatgagtgagtggtaactaggaacttaaatattggtatataatatattttttagattttaaaatttgttttgttgacctaaaaatatcagtagaagaaaatatttgaaaaatcaaatgctatttgactagatgctaggcattacatgtgattcaaatcacttgatctttataacaggaaagtgatgtattaagtattaagaaaaaaatatagaaactgatccttttgtgaaattttgttcactgataaaagttttatattaataaatgtgtaaattagatttttgagacagaaagcaaatgtttctaaaaatattttatgtaggataagaaacaaggaaaacggagaaagaaaaagaagaaccgttcacataaatcttctgaaagctccatgtcagaaactgaatcagacagtaaggtaaattatttaaattattaatatattggatacaaagacatttaattaagtttttctgcctaaagttgctctcaatttaaaaataagatagtctgatatttgtactttgatgttctatgccacttaattgatatacttgataatatcttgcatgtgacatttaataattcaagtgctttcatatatatatatctccatgtctccacatttccatggcaactgacattattgtccctgttttcataaagaagttagagttcagataaaaagcattggcttaaaatgatacagctggaattagaattaaaagttgagtctttatcttctaaaatctggtccaatgtcctttctactataccgtacctaaatttgttctgtactaaccaggattgtcagacacacagttggctttcaaacattactggtcagaaaaaagttaagaagttctcggaaaaaagtgttgattcctgagc

SEQ ID NO: 15756 - DNA, 1113 bp, Homo sapiens; identical to SEQ ID NO: 15755

SEQ ID NO: 15757 - DNA, 1186 bp, Homo sapiens
gcccaggatttcttcacttttaatagatattattctgtatttatattaaaaactcttatttcaaagtaaaatcattgaaaaagaaatccataaagcatggtaatttagataaaagagcttaaaccttgaggaatatacttttaaattcaatgtagttttgttgagaattccttttcgttgattagagaaagattgttttattgttctccagtagtcccacaaattcagtttatataagattttagcagatgcttgaggaaacattaagtagtagtaagagtaagattcattacaaaactattattttgtttcctgtaaaacactaggcatgggttttaaggcatagaaattcacatgttaatatcttggtaaacttgattatagttgctaataaatttacaattgcaatttataactttatttaaatttgtttttgacttctaaatctggtatgatagtaaatgtatttaaatgttaactaaaagtgagaaattagtcttaatgttttcttctcattgccttgaaaacataattccttaaccatgtcttgcttcttcttttaattatataggaacagctggacgtagctctttccaaaatctgcaagaattttgacattaaccattataccaaggttcaacaagcttatcgacttcttggaaaaacacaggtttgttacaaaaggatgtttggatttttccttaatcaggaatttgttgtccttcatgattaagtctgaatattattaatctcatgtccttaaaaagttttatttaacgaagtacatttttattctgaattaacagtgataaaatggttgttcttgtagactcagagggtatataatgtggttaaaacattacagtagtttgttttgaactatgaagtacttgtcaggtttaatattttcacaattttatgtagattttccaataagtatattataagataattcagtgggagacaacatgtagtctcttttaactcagctcttggttctgaaacaggacttcctaatttgcagcttcacgtgttgttagatagccagcatgactccctcaaaatgatatgtcagcattgtacattttgtacctttatctgtaaaacaagtccattttatttatcacatatttcagagggtccttttatccccaaaatgtcataacttctctcataatatatggct

SEQ ID NO: 15758 - DNA, 1497 bp, Homo sapiens
tgataatgcacaaagtacttacatttattgttaattttttttatccacataattggaataacacctaaatagttttgagttgttgaattactctgtggagctgaaagaagtgtttattggacaatgaaagagctttttattcgctgagagtattactgtattttgcatggagaaatcaggctgattatccaaggttatcaacaggctcctgaattgattaaacacaaaactgtcattacaaatgtactatggtaacagttattcaattacttggatatgcatatgtagactcttagaatctaactgtgatattttatttgcctttatctctgataggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaatacagtggtctttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaatatattagtcgactgtgttacttctttaagtctcttt

SEQ ID NO: 15759 - DNA, 1176 bp, Homo sapiens
tcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtatgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaat

SEQ ID NO: 15760 - DNA, 3583 bp, Homo sapiens
agagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatctgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgtttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaa

SEQ ID NO: 15761 - DNA, 1146 bp, Homo sapiens
tccgatgtttttgcttctatgaataatgctgcatcttgatatattttgtgtacatgtctgagtgttgtgggataggctcctagaagtagtgctgctcagagccctttcttgtcctccaagctctccctctcctaagctccctgcaaatccttctagcatgtaatgaaccatattttattgaaagtatgaggctgttcccttcactggaagttcctaggggacacagattgtcatttattcattgttatatcctcagcactgagcacacggtagttaaaaataaatttgaactgaacttgaaacttgaaaatcaatatccaatgttttaattttaaagtcttggcctgtcttttacagacttcttcaatgttgcaataatttttttccctagtataattggatcataacatagatctcctgatggccacagctatcaacatataggtaactcagttctttgcaacttacatttcagaagcttgtcatgacccaattacacaggcgtagtttcttacagaataaatgttttccaagtctcttgagataattctcctaattagaaatcaggggtgagaacctttatgtaatcagcattgtggtagattgaaaagaatacaggttttggagttgatgtttgaaagcatcttctctgtggtattctatagccatttacttaggctgagtttactggtttatgggagatccagttttttcctctgtaaaatgaagatagtattctatattaagatagggcactggaaaggctaatggaggtcttgaatgtgaaatgtttaatgtgggacttggtacaggtacgtacttgtgaaatattagttcccttcccaggtaccatcagagttttcaatcttgaggggagctgggctgacaacatattcactatagttttctatatcagtggggtactctggtagagtagaacaggggtcctcagaccctgggccgtggtctggtaccagtctgtggcctgttagatactgggctgcatagcaggaggtgagtggtgggtgagtgagcattactgcctgagctccttctcttgtcagatgagtggctgcatttgattcttaaaggtgcatgaaccctattgtgaactctgcatgtggagggatctaggttgcaggttcc

SEQ ID NO: 15762 - DNA, 1453 bp, Homo sapiens
tgtgatgtaagtgttcatctgaatttactctgtatttacattctatccatgatgtctgtaatagctatgactataaaagggagggccagcctcattactccttggatggctacactgcagtaggacccagaggatgtgagtatgggaatctgatcctgagtcctgctggttggagagttgccagtgtcatcataacttgtaaaaaaagtcccataagacacttgtaaaggataagtcttaaagtatgtaagaataaatcagaaaattgccttttttaaaaaaaagctttttaaaaagctttttagctggtgattgtgtctttcttttctttaggattctttaataagtaattttagtaaagtgtcattcttagttgctaaagaaaacagtcgtctcctgttttcagtcatcagattcaagcctattaggaaaaacttgaataattattcttacacgtctccattaatatgaagaatcatgcataaaatgtagtccatgcttatctctaaaataaacaaggaaataaaatttccgggttctgttagttgttagaaaacatggtaactcaacttgttattctgcaccttgggaaaaaaatgcttccttgttgattccaagtaagatcatttagaaactaaagtctaccatgtagagtataaaaatgagattgttaaggggatgctcctttattctgaaaactctctaatgagggaacaaaaatataaccctggttttaatatttatgtaactttttgcagaaataatttaaaatagggagaggtaactttcaatcccaaacatagatcaaatacttagtaatttatttgacctataatgctggttctcaaccctggctactctttacaatcacctgggagcttcttaaaattaccagtgtgatcttaaccccagagattctgatttattgttggtctgggttagggcctaggcatggttaattggattccttaggtaattctaatgtgtagtcagaattgaaaaccactgccttagaaacacacagttgaactttcttttatcttcatatggaatcagaaaagtaaagaggaagaaaaggagtgacctgtagattagctacccatctgtacttattctaaaagatcaaggtagggagcaggtgaaggcttggattttgcaccctttgtaccagaacacatgggccagtgtgcagtactggaagtaaagttcttggatgttacagtgtggtggcatttcttgtcaggagagaagggaatgatagattgttttaacttttcttcttctgcttgactttgagtaaaaagttgagcatctcctgcttttttagcattttaggaaaaaaattattgtgccaagagtatcaggtaatctgtcataaaaatatatgaatggagcagatctgtgcatcacttcaaactaaagatatataaaagcattcctttgtgcttttttg

SEQ ID NO: 15763 - DNA, 1186 bp, Homo sapiens
attctctcacagaagtgcgtctgaaaatacatagcaccaaattcaaatccggtaaacaaattccatcaaaaactgcataattaaggctatttttgtgattagcgccatttagtttccctgaatttaccagagcaaacattgctacagcaaaaattactgctaatggttgaacctaacaacaagagaaaatccccagaagggtcatttaggccccagctgcagctgtgtttcactatatttcatcctggaaagctgagattaacaggaaaatcaggctctactgtgctatgcagatgtggctacaactatctgaatttattcagcaaacatttgttcagtgcccactatatgccaagcaatgtactagccacaccgggattgcagggataaattgtacctggcactctctaggaatgttcagatgaaagaagttgatgagagaaggcagatatagaaacatcaaagcattatgagtgatgtcagctatacagtgggagcataaaggagtgaattaggagagtcttaagggcagcagcttcacaggatgttctcatgtacacggttattcatcttgaatccttggggcaggttggggccagtaaatgaggaggacagaggcatggaagttttcttgggcttgggtagaagctggtgcctaccccaaactgggaatataagtagaggaacaggtatatatagaggaaaggaaaagttttacttcagaaatgaccaatttgcttataaaagattcatgtgttgaggtcttctaggaacttacatttatgagaccaaagtttagcaaatgtggttacaagatacagatgagaaaatcgttagcattttgctattgcagtattttgacaccagcagcagcaacaatagcggtcactcgttttgagcacctaccatgtgccagaccttgtgttaaatacataggcaccatctaacttaatcttatgacagctttcttatgctaaggaactgttttgtccttactttatagatgaaaagattaaagcttagatatagacgctaattcccaatgtctcaggaccaggacttgaacacagttctacgtgacttcaaaaccaaaatcctttcattgatccccacttaaccaactccccaatataacagatactctctgttccttctgcaaaacctagactgatatctatagctctca

SEQ ID NO: 15764 - DNA, 1166 bp, Homo sapiens
caataattaacaagcaaacaaaacagaactgtttgaactctaacgcttaggagaattaatcagctaaacctttgcaaggcttaattaaggtcccttccaactctgtgattcattaaactccccttcccttttcattgctctcagtattgggtggcgtattcacaaagagaatttaaagaaatgacttatttccctcagcaacataattttatttggtaaaataatcaaatactcagaaaaaacaactcttgtttctgtattaaagatgccactgatactagtagatttttagaaacgcacttgtatatggcataggtttgtcactttggatctttaaactaacatttgtttataacattggctgcatgaggcatgcttggctgaaaaacctacttacacttttaccatttgggtacatgtcttacttgtcttttataaaatattttcaaataactcacctccacctggggtaaggacagctggatttctgaaatccccttcctttcagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagaggtatgccactaagctgcaaaatatttctttatgcctgtccatttcattaagtatatatttctgttcaaataatatattaagaataatcagtttgcaaatcaaagctttttaataacaggttgtcttgagtctcattgaatttcaagtagaatttaagtagatctcgttccacggtcattgatttaaacgcttatttgtcatagtgacatacctgtagcccataatttcaagcagtaacttaaatgtgcagttttatgatgtttaagttatattttttcagttttacagaagttttggtaactagtgataagcttttctctcaaggcagagacttcctaaaaagtctctttttgtctttctgttcatgaaataggtttctaataagcatcagatggcatacccaaagggtttacttgaagagagtttaatacacagactttgaacagagttaatagtactaacaaggggtggtgaagtgcacagggactggcaacagcaggag

SEQ ID NO: 15765 - DNA, 1676 bp, Homo sapiens
ttagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacac

SEQ ID NO: 15766 - DNA, 1987 bp, Homo sapiens
gagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgaggtctgttgaagcaattttttttccctcttccattttcaccttcaactaaaacaagccttgactgggtaaacctgtatcaattgtcaaagcatatatctgtcaatcaagagcaaagtgcacatttttcatggaaatgaaactaagtcttaactgtggtaaagtgtaaattggcagctagaaattacatttgaaagcacaattatggaactgggcataaagttaaaagagcaaagcctgca

SEQ ID NO: 15767 - DNA, 2762 bp, Homo sapiens
gggggtggttgaatgtgtgagagaaagcacctcctgtgactgccagcagccacagaagaccatgaagaggaaacgcataacaagcttcacctctgaaaaatcggacctaataacttcgcaagtttttgatttcaacaggaaagaaaaagaaaagaaaaccgctttctccacttattctcaaccacttgaagtagtgttattgataaacaatttcttaaaaatatttaaagatttaggaatagaaacaaaggaaatgaaggctgagtgatttgggcaagggaaggtgtgagtctggtggggaggggtgtaggagcagacatcttgcacacaggagaggcatggttgcatttcccatagaggacagcaaaataggcattttattgaatcggatttttaactttctttccacggccagcagttcaaagcacagttatttttatatagtgagaatgtgaccagactgagatggtgttgtgtctctcctgcaggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtggtatggaaataatgtgttcttaactaactctttggtatcaggtaaatttttaaaatatctaattatatctgtgatttctccatttttttaaagctcgtgtatttcgatcctcaccccagtttggtgtaactttgctgacttacgaattgctacagcgatggttctacattgattttggaggagtgtaagtatcatgctaaatctgctgctaaattttggctgctgctaatgctctgttgtcgtagggaaaggtacctcagtctagtctctataataaaatagaagagatttagggaaatgttgaaattgtgttaacaaggtcatttccaaggggaacatacaactgatgagaatgtatcaactcctttacattaaatatttgaacaggttttgaatgttatttttatcaagttaaaacaaacaaaaaatacagcttcttactctgttttctcttcttttagaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtgattgagttgtttggtcttgtgcatgttgcatggtgagtggatacagtaattgtcattattggcctacatgttttgttttgaggggaattttattcatattggcatggatatatcctcagtatctttcaaggtaatgtgttccctcattttcatggttcaaagtgagtacaagaaactgtatttaaccatagataagcaaagaactagcaaactgacaccttagttctagtcattccagcactttcggcagtttattgtgatgatgaaggtcacatagttttagtagaacttagccatgaaaactggtatgaaatggcagtcgtattttctaatccagtctgactcttgcacacaccaaaaccatataccactgtatctaacatttgctattatttggctagcactataatgatttggggaaagaagctagtcttgaacaggatttaaggctattcttagaccgtgatcatgcttccaaagaggctactaattaatct

SEQ ID NO: 15768 - DNA, 1171 bp, Homo sapiens
ataataactttcatctaagtttacgtgttcgctggcagtttttgaatcgttgccagaatcatgaaattcatcattcaagagcctttgtcctcctagtccccgttctgttctgtgtctcctcatttggatacgttctgtgtctcctcatttggatacgttctgtgtctcctcatttggatacgaatgcttttcattttattactgcctttgtgcccttggctttgagtcctgtggtggcagttgtttgtgcttcaaggagcatttgtaatttcagtgtgaggacttggggaggtcaacagaaatctctggtctttgccctccttcagcctccacattaaggacatagggcttcttcctaggcagtaactgtattttgattcatacttgtaatccctaaccgttttgattgatgggacaagggctgaaactacattctcttgaggatagaatatttttatccttgagaataatcattcatctcttcctgacccaccttaccatttctttgctttgatcctaaatcttttttgttctttttaggctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaaggtaacttttttttttttttagtcatttatttgattactttctcatctcctaatgcagaaactattcttcaacatgaaatccatttttttttgcatttctacacctggagaagatgttctacccaagctgcagaggcaccttcatgccaattagaaggaggtgccccttcctgccatctgccaaaaaactatcctcatcaatacacaaatctaggatgactatgataggaatcgtgccctctagagttgttcagtgcagctctttgcagcaacactggctagaattttatttggatttgttattgatacgctgagttcagttcaaggagaaacctgtatcataatttattttctgatcctatgcatatggtccgatccatgttttctctatatatgtatgccttgtcttaattattataaatcttaatcatttttcatttagaaaatgttttttcagaatgattacaaaaccaaacttctagatgattctt

SEQ ID NO: 15769 - DNA, 1837 bp, Homo sapiens
tttttgagatagagtcttgctctgttgccgaggctgaagtgcagtggcgtgatctcagctcactgcaacctctgccccctgggctcaagtgattctccctcctcagcctgagtagctgagactacaggcacatgccaccatgctggtctaatttttgtgttatattatagagatgggctttcaccatgttatccaggctggtcttgaactcctgtgctcaggtaatccgcccgcctcagcctcccaaagtgctgggattacaggcgtgagccaccgtgcctggcctcagtgatgtttttaactgtgcattttttttaatgagaatttgaaaataggcttataacatcatttttgtcaaaggatggttttgattatattgaaatttggttttaaacattaatagcactaaaatctttttattaataagaacttatgaaatccattcctacttttttccttgacattttagttgtatcatggatttagaacccaatgagtaatgtttaaagttaatgtatggtcatttttgttttatcttcttttctgtcacctgttttcctgctctctgattcctgtgcatgcaaagcagaaggcctcaggtgattcagctcgaccagttcttctacaagttgcagagtcggcctacaggtttggtctgggttctgttgctggaggttagtcatggatgagagaaaaattttcacttttgttattcctattctcttttctctgattttccatcttgaaatgttaaaggacaaagtcttctctagtctttcccaatgccagttatcagtttctacctgtgaggtagggcaagagtaaagggaactcttttcccatacctgcatgtgatcagggacttacaagtggcattttcctctatctacagatcaggccttccaaagacaggttactaatgaggttgggctgtagcaatgtgccttaatttaaaatatctatgacatccttttattaggggatacttgaatgaaaaccctcaattgtttattaaagatataagaaaggtagtactgttttaaaatctgtatttaaaattcaaaacacatttcttttctcagtcttgtccttgactttaactaccttcttctttcttctgacctatcttactttcttctgagataatgatattgtttaattttagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggttagtgccacatgctcaatacctgttaggtgaaataacactcaaaggtttggtttctcatcttagtgcctgacatgaattagcaagactgcgttaaaatggaaatacagcagattttcaattatccatgctaatgggagtaggctggaggcatctagggcttggctaatcaaaacagcccataatctgaaaattatttatagtgctctgttgtatgttttatttcttaaaataataaattatttttataagcatcttccgtgaatttttgaaaggctcacattgtttgcatccttgaagtactctattctccagctaacagggaaaggtattctgccaccaggacaaagcctactcaggattcatgattttcctggaatacaccacaaaaaagataacgaagggttcagtagagctctcttttgctgcttcatcctgaattaaagttgccccttttcttcatctgactctcaacccaatggagttgattcacacacccctctagccaaggtt

SEQ ID NO: 15770 - DNA, 1211 bp, Homo sapiens
tctgtacctaaatgattatttattactggttataagtaacttgacaagtcttgatattaatgttacattgactacttttcatagtatgtttgcattgatacaatacagtttttcatgcataagcacacacatgtgtgcatatgtacttatagtttttgcatgtttaagcctttaagatttgctcattagatgaaataaaccaacttataaaacatttccaattgaaatttgaactctaaattactactagtcctgttataatcctacacatgtatttatttagttttctaggagttgtgtatggagagtacaagttctggtcatgattagttgcagttgcttctaaaaatcatttatagcttttttttaatgcaaaagaaaaatacttatagtcatttcttcttgtacatgcatttttgattactttcaaactagttttagatgtatgtacttctgaatcatctataaatcttttgtatatttttcttctctcttgttttcaatttatttgaggctgctggaggtaccacatcccatcaagttagtttctcctattttaatggatttaattcgctccttaacaacatggaactcattagaaagatctatagcactctggctggcaccaggaaagatgttgaagtgactaagggtgagtgagaatatatctgaattctagcctgcaagtattgtggtgtattattattagggtgaagaaggcaactagtactttattatttttctatcccattgacacatattaactatatgataacgtgtgtttttcatcctttgatcagacaaacaaaagcaaacaaaacaatcttcaccaagttttaaacaaactgggcccagcttggtgactcacacctgaaatcccagcagtttgggaggccgaggtgggtggatcacctgagatcaggagttcgagaccagcctggccaagagggtgaaaccctgtctctactaaaaatacaaacattagtcgggtgtggtggtgggcacctgtaatcccagctacttgggaggctgaggcagaagaatcgcttgaacctgggaggcgaaggttgcagtgagccgagatcacgccactgcactccagcctgggcaacaagagcaaaatgccatctcaaaaataaataaataaataaataaataaactgaagacaccctttgaataaggaaaacatgtaaagtttcttaaatatttt

SEQ ID NO: 15771 - DNA, 1200 bp, Homo sapiens
gggaagagaataggggtacacacgacagccctcccgtaataaagacttaccctgtccaaaatgccaataatggcaaggctgagaaaccctgtgttggagaaatagcagagaagaaccaccactcttttctatctattgttacatcatgtgtttgggtaccaggttgcagttaagaatttttctcttttctttggagagaagttaaagtccctggcagtgtttttcctcagatcatctgcatcacctaagctggggttggccagatctttgaacctacaacacttcattccggttttcattttctttgtgttcatggactctagagagcacggaagtaattgggtttcattgggtagcagagtaaggtagagtgcactttctcaagacatgttcattggtctgagcaaagttctgtctcttggaaggagacagtagcttggtggtgctattaggcagatgagggcttgttagatcaagatgtaaactctctttcttcagtctgattttaaaatgaactgtcatttgtagtaattattaaatgagaagcataaattaagtattttactttctttatttgtaggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgtaagttgtaacttgccctaatgaagtggtttaactcagtaaataaggaattataaaaacaattcttataagttatgtagtgttttttttctgttgcaaacactaacattttaatgtgatcacatacattactaaactcaaacaaagagtgtgttttggctagttttagtgggtaggttaatttgttgtctgggtaatacggaatatcttcgagaaatacattagctttttaaagataaaaggaaaaacagatttgtgatctcatgttaattttgttttagattttgaagtatatcaagggctgatttttgctaatcttcttagatgctctaaggcaaaaaaaaaaaaaaaatagtgcacatgtatatcatttgttagagtagttagcacaacagaaactccaaaccttagattccctttcaccgtgtatgtgtcgaggccacagagttacatgtgacagcagagccctgcag

SEQ ID NO: 15772 - DNA, 1197 bp, Homo sapiens
cactagtctgtttctagaccagtgctgtctgcctcactagactagaagtcccttggggtcatgtttcatgtatcatttatctgtattccccttgtactagccctaggtcaattcacaggtggtcagtaaataccagtagtgaatcaatatctgtgaaccgttttttgcatggtgtataaggatactaatgcataacaaagttgctctattttgctgttaggcagtcacatcttagtctaaagtatctgcacttttattatagaacccaaaaacatgcctgaaggaagactgaaacatatatgatgctggataaaacagttatatttgaaattataatgtatttagtgtgtaacttcatggtcaatgctgtcatgtcttttagattctgtgcattattatttcagtccactatatgtaaaagtaaatgctaaatgtttataaatgttttcagtttgaattttatgttttggcagtgatatcttattttttccctcagtgtatgtttgtatatgcttctgttttccacaagctactgacttttgctttatgtttgttttatgttgcagattaatatcttttcaagaatttgttgcctttgaatctgtcctgtgtgcccctgatgctttgtttatggtagcctttcagctgtttgacaaagctggcaaaggagaagtaacttttggtaagaagcatgcttctgtgcacgtctgtgtaagtgtggacttgtgtgagcattttcttttttttttttctaggaacaaaataaagtgtatggaaattctttatagaagatagtatatcccttttagtaaagatacttcaatgttttggagctccagttcaaacatcttcctattcgaaaaaaacaagtttctggcttagtagttttgatactctgatttagttttaaggtgagggagatgtggcatgactgttttcatagagtcatagcatgtgagagccagacaggacttctgtttcttccctgcatcatcagtagtgctttccactgatagaacgaagaagtgaataatctgcctacacacagaagttacttatgcaccctatacttcttgtcttcacgttgttcccatggagtagtttgcggccagagctgctgcacaagatggtggttcagaatggtacatgaaggaccttgttctaaacaacccccgctcccccgacctgactgctgtg

SEQ ID NO: 15773 - DNA, 1146 bp, Homo sapiens
tctagaaaactaaaaactacaatattcttctttatgcatatttatgtttattcttcctttaaaaatataaattttgtatcagttgtattaggcagatactagtggtggcttacagtttggtctacttttaaatatttgtatataagttatccttacgttttgcagttttgaatttcacactggtatcttcctgccattcaacttgctttagggttgttggtgttgtgttttgaaagattgtgaagtcgaccttctaaaaatgagttcaaagaaaaatcagtaaagtaaatatcctcctgaaattgtaagtttcttggcaagtagaattttttgtattaacttctgttttaggttatctgcaaactcaagaattgagagaactagacagcataagctcagatttaaggaagataccatttttcatagatatggttttagctgtttttgaattgtgagtgttcagtagcaagcttttcaaagtttttgtaattgtggaaataatgtatgagaaatatttagacagcatctgtttctatttttagactgggctggcttagatgaagatgaagatgcacatgtctgggaggataattgggatgatgacaatgtagaggatgacttctctaatcagttacggtaagttttaagccagatttttattgtagttcagtattaattataagcatggaatatgtaatttacatagatgattaacctcttaaaagctacttaatctttgaaataggtttttgaactgtgtaaagtaagacatattgtcttcatctcctgtgattctaaacatgaacactttgtgtaattgcatacaacttttattctttctggtctttttacaaaggtagtaaaatagaagcatatttgctatttcttatccttaggaatttaattctgtcaatgttaattttctaccaatatcaaataactcagcagaaattagaatcatagagtgctgggacctaatagattggtgattctcaaactggaatggagattggggttgtgagaatgtactgtgtcatattcatgtataaatctacctgatttcatttatttattgaggtaaaattcatgtaacataaaattaagcatttgaaagtgtacagttcagtggcttctagtacatcctca

SEQ ID NO: 15774 - DNA, 1346 bp, Homo sapiens
tcattttgtatttagtttgaatgatacatgtatttagtttgaatgatacatgtatttagtttgaatgatacatacatcagatatctctctgataggatgtccctatcagagagattcagagtctctgtaaacaattatctcttttgtaagaattacgtaagaattaagtagcatgaaggattataaagtagcatctagaatcgagagagagaggagacttactactaatcatcactgattttcatttatcagatttttgggcacctgctgggtgccagatcttgttaggcacaaatgactaaaacagagccaccaagtattaaaaatatgcatatgagtgttctttaaaaggcactgcagctatccatattatgaatactttagcattttctaagtgatgggtgattcaaagggtctcatacaagttacagtcacgtcttaacattttctgtttcgtgaaatgagactaaacacaagtatttcctgccattttaagccattttgctcttatatgcttattcttacaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaccattgctgtagtcatttatgttcatgcagtctcttcataagaggtaactagaactgttttgctgtatcacagtaaagtggagggtaagctaggaaaagggaaaatgatcagatgtctgcaagaactcacagccctctcctggcagagctgctttagatgacatttgcatcttgtgcccgtgtggcttccttccagtccttgcctcatcttagggacgtcatcaaaggactacactatttttgttctgcctacattcctaacagctgcctaggcagactcagacttgaatcttctataggagttcatcacagctctattttgcaagatagtagttcatttttttctcttttatgttgagccaaagccacttctggagacttgtcctagagcaggggtcaggctttttttgaatttttaatttgtttttaataaagagccagatagtaaatattttaggctttgtggacctcttttgga

SEQ ID NO: 15775 - DNA, 1093 bp, Homo sapiens
aaacaaggttgagaagaaacactggtttagagagatgtggtgcaggaccaaggaggcaagtttaataacttatatagtctccccagctttatgtgaaatctggtaaatggggagtggcagggggaaaatacccatcaaaattaacactaaaccaccaaaacggttattcttatttttgtgtcataataccactatgaaaggcatgatttttaggtatttgagtcattgttcagcttagcaaagttttgaggtggacattcttggtctaaaaacattagaattttaaaacctgtttagaaaatgacaaaatggttccgggttattttattttacagtagtacttttggattaagtacatataaatggcttataaatacaaggtcattattgtggaaactactttatattaatatgaagtccagtatagtagtaaagctttcaattatttccaaaaatcaaatcaaaggcatttttggtggaaggttatgttgacattaaagttaatttctctctctcatttaaggtatgtatttaatttccaagtatattcggaagaacacagatagcgtggtgatcttctctggagaaggatcagatgaacttacgcagggttacatatattttcacaaggtaaccactctgaagtggagggatattcatgctatattaagaaaagtatgaattgtttgactattttctatcatctttcagtatgacagtgatatttttgagtatcttgtgaggttacaaaagggaatctgatagtgtttgctttctatctcttggggaagaaagaaattttaatgtgtcagataatttttattctttaaaactagttacagctgggtatgagggctcatgctcatacccccagctgctgaggaggctgaggtgggaggatcacctgaacccaggagattgaggctgcagtgagctgtgattgcaccactgcactcctgcctggttgacagagtaagaccccgtctcttaaaaaaaaaaaaaaaaaagttaaaaataaataaataaaactacttaagcttgagaatcccctttctgccatttcttagcatcctgtggaattatgactgttgcc

SEQ ID NO: 15776 - DNA, 1131 bp, Homo sapiens
aaagtaggtaaaagtggatcattgtacttgttaaaggtctgggaaccatggctgtgttctgaaaatacctcagtgatgacaaataaatgactcccagcctatcataacattaggactccagttcatccctttgcttcataagtgtgtcttttccttttgtgtatttgctttagtatagaaaataggttttcttgattagaaatctaagaagaagaaattgaacactggagatttttctatttctttgaattacgaaaagttagtgtaatttggcagtatatccctgtgccattattgtctctcaggtaagtagatggtagggcttaggaaaatagaaaattttttttcctattttgcttatttaatgggtatgtgtttgtattaaaaagggaaaataggaatgtagatgatgttaactaatcgtgaaagttattgggaagggttacctaatttgaataaaggtatcattgtgaatttctaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggtagcagacacccacccacctattccccatccttctccaagggaaaaaaattttaagttgtattctcccatcatttgaatgattttagtttcaagacctacttcctattttgtttggagggaacacattaagatttggcacactccaccattgagtaaataccatcatgatagatgttgatgattgtgtatttcatttcaataactaatccagcccaagattttctggagctgtttgatttactgctgtgtttataggttttgagatagaaactgtgaagaacaacctcaggatcctttttaataatgctgtaaagaaacgtttgatgacagacagaaggattggctgccttttatcaggtgaagtcaattaaaaaaacctaattatatttcatgtgtgtttaattgaaatgatttgtagccatccctttggtttttactataaaatatttactgtatgattta

SEQ ID NO: 15777 - DNA, 1145 bp, Homo sapiens
atgcccaagatatctcacatatatgcaaatattccaaagtccaaaacacaaaacacttctggttccaaacatttcagataagggatactcaatctgtatatatataaatatatgtatgtattacatatatggtatgtatataatatacatttccatccctccacaggttactgttctggcacattcccattatgttctgtttatcagactgcaactaaaattttcatgggttcggctttatgttgaacagaatttgcagaatatgagttgaagcgaaccatagtttaataatgctgtgattctcctaaatcaccaaagtgcatgaaaggattatagagctcagaaatactgaagcatctttgcaataaaaaattattagtgaatgtacaaggagtctaacattttggttttgctttcgcttcctaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtaataataaatttttctatagattttcattattgtcttggttgtacgttttcttttaaattatatttgaaaatctcttagagagcaatccagaattttacaagtgactaagttatgagtctttacctttttttaaaaaaacagaggagttgtactctccttttcagcacttaaattctgtaatccttgaaggatgattctttagtgcagtcgtttattttttgctgtgctaatatgctctacatctagcttgatcttaagtgcagttttaagttttcctgtgtcatactataatcgtagggttgactctgcaattattgcattgtggtactttgcgcagttatagcacagcaagtgttaggatttctaaaacagctttattgataattcacataccatgtaattcacccacttgaagtatacagttcagtggtttttagtatattcacagatgttggtaaacaacactccaatcagttt

SEQ ID NO: 15778 - DNA, 1249 bp, Homo sapiens
taatatagtgaaatgcttgaaagagctgcgtatcttttacacttacagcagtatgattttctgttgtacccattatatggtacctgcagctagttcagataaagagggcatttaactgtcaagggaacctgagaggagactctagtaatctggaaagtctgttggatctttgagggattttgggatggtgagagtggggctaggatctctggctaggttggagccagcctgcatttgtatctgtatcttggaagcaaacttagaatgcagagacagatgtggcatggacgctgtcagctctagccaaccactaaatcctaaggtgggagagatgcaggctttggctaggtgctaagctgctgtagccggttgaatgtagaggtcactatcttttccgaatacctgtaagtaaattaaatcattctctactcccatgtgcctgccaacctaatgggaaatcgctatagaaaagatggtttaaattttagtctttgaagtggtttatgcacgtttccggaatcaagatttaatgcagagttggattggatattgaatatttttgatttgtctgcttttctctccatagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaaggtgaggagaaagaaaccagatgtctggatgcgattaaacttcagagtttgttggttacgatgatgttacatattctgtatcatgctttttcctttgcaaagcactctatgttcgttatctcatttgctctaagtatgtaaatagggaactgatgaataaaaaggtgagtgaaatgacttggtcacaaaaaaagtgataaaaatggggattacagttcagtttcattgactcttagaattttttctccttctccccagcttttcattttgaaaaaattcctaacatacagtaaagaacagaacaacaagcacctagattaaatagtcattaatgttttgccatagttgcttgatttttctttctacacacacacacacacacacacacatgt

SEQ ID NO: 15779 - DNA, 1835 bp, Homo sapiens
ctatccttctgcctcagcctcctgagttgctgggactaccatggtgtgccaccaatttttatagagatgtgatctcgctgtgtttcccaggctggtcttgaactcctggtttcaagtgatcctcttgccttggcttcccaaagtgttgggattacaggcgtgagccaccgctcctggccccgatttattaatagatcttataaggacattttaggcctcacgcatcagtttcttaggacaagcttttctctgcactgcataataaatcagacggcagtgcaacaaaaaaacggtgatgatttcccgaagaacaaaccaagttcagaagcctccctaattgtcagaacagcaggtagcctgggcggagctctgaggctatccttaaacaggcgcactgagacgcaaggcgctggaaacaaaagagctcctccttgcgcccttccgccgccccacttagtcctgctccgccccggacaccccgcggccccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccaggtgagccgggtcctgcgccccgtgccctgcgccccgcgccagcatcctcctcgcgtgccctggggctgctccggaaggaaggggtggaggatgcggtcttcagcctggcacccggcagacgcggttcgcgggcgcctgctgatgctgcggctcctgcggtagggagggcggggcggacgcctagcgattgttacgcacctgacagctagcggaaggacctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagaggtctgtttagggacacaggcgaccaagtacagaaaaaggcaaaagaactagcatgcctttttcaatggctgtcattttgcagggctggcttcagatgattgttatagctttaaataaaaaggacagttttcatctcggcccgtggcctacattatttctttactgtccattgccctgggcgcttgactaataatttaacagcagtttttttttttaaattttaaatcatgattcatagcattgctgtaagagtaattagaggtaaagtagggcttgaacctgtctgtagttggttacttactgagatcttaatataaaagtaaagggagagggtgaagttgtaagtagcactaagtggaatagaaattaaatgcactgaaactgccatgtccagttcggtaggcgctagccacctgtaactgttgagcacttgaagtgctggctagtcctaactgagatgtattgtgttaaatacactggattttgtcgttggagtaggaagaacagtgtaaaatatctgctcgataatattttatattgattacatatatgttaa

SEQ ID NO: 15780 - DNA, 1368 bp, Homo sapiens
aagaaacgccccgtcgggtacccccagactcactcccaacacagggagaaacccagcccacgtgtttagatgttattgtcccggaggactgtctccaccaggacatcagtccagacgctgtgactgtcccggttgaaattctctcaactgatgccagaacccacagcctggataacaggtcccaggactctcctggcgagagtgaggagaccctgcgactcaccgaaagtgactctgttcttgctgatgacatccttgccagcagggtgagtgtagggagtagtctcccggaactgggacaggaattgcacaataaaccattttcggaagaccatcacagtcatcgccggctagagaaaaacttagaggctgtggagactttaaatcagctcaattctaaagacgcagcaaaagaagcaggcttggtgtctgccctctcctcggactcaaccagtcaggacagcctcctggaggacagcttgtcagcacccttcccagcctctgagccgtccctggaaaccccggactctctggagtcagtggatgtccacgaagcgctactggactctttaggatctcacactccccagaaactagtgccccccgataagccggcagacagtggctacgaaacagagaacttggagtctcccgagtggaccttgcatcccgctcccgagggcaccgcagactcagaaccagccaccacgggcgatggcggccacagcggtctgcctcccaacccggtcattgtcatctcagatgccggcgatggtcacagaggcacagaagtgacccctgagacgttcacagctggctcccagggttcataccgagactctgcgtacttctcagacaatgactctgagcccgagaaaaggtctgaggaggtcccgggaacctccccatccgccttggtgttggtacaggagcagcccctacccgagccagtcctccccgagcaaagtcctgctgcccaggatagctgcctggaagccagaaagagccagccagatgaaagttgtctgtctgctttgcacaactccagtgacctggaattaagagccacgccggagccagcacagactggtgttccccagcaggtgcatcccacggaagacgaggccagcagtccctggagtgtgctgaatgcagaacttagcagcggcgatgacttcgagacacaggacgatcgcccctgcaccctcgcttccacggggaccaacacgaacgaactccttgcctacaccaattctgcgctggacaagtccctgtccagccactccgagggcccgaagttgaaggagccggacatcgaagggaagtacctggggaaactcggggtgtcagggatgctcgacctctcag

SEQ ID NO: 15781 - DNA, 4169 bp, Homo sapiens
cccgtgcacccgcggccgcggcctcccaggcagtgctcatgcgctggccgtcgggggaggcaggggcacagcctccatgtgcgcgcgcgtgtggagctgtgtgcaccgcatgtgtgctttccacaggggcgtctctgcgtccacgcctgcacatcccggcgcacgtgtgggcaccacagaggacacgtgaggggaatggtcaccagtgagccatatttattatttctagagaaatcacgaactgctttctgtaattgcactgtggataaatgttccgagagtctccattgttgtacaggatcttcagttattcgaggggaatgaggcaggtcaagccgatgctagccactagtttgattttttttctgttttatagtttgcgctgcatggtacttgtgaagcttaaatattttgagtgttctactgtgtctaggattgttgggattgtacatatggtactctttcataaatgataaatgattctgaatgttagtgttttatgttcatataggaaatattttcattgagtccaaaataccactgttttgttgatggacttgaatgcatttttgtctcttcttgatgaagcggctttgccgcagcaaatgaggcttctctctgaggagctgagaggtcttgcagcctctccttgtcattctcccaccccacatcccattttttaaagcccttttggtaaaaaccaacaggttgtggccgcagacctcagatggacccggcccatccctggggacgtgctggcgtggcaggtccagagagctgcaccctgcacggggcaccgcaccgcttccctccgcgcagctcttctgcctggttttcggaggccaggctgctgggaagcttccgtgttcctgtcagtccttccttcaagaagccggggaactcaggcagactcatctccgcagagcataccagccgtgggggaccgttcgacttgatgatgtgtgcacacttcaggtggtggggacttgagctttaaaaaaacctccacagccgaatcttctcctccgagccactccacgtcacgtccagctgggcctggccagtctgtggttatccatgtgggatgagataacaccacatcctgcagctgtgaagggggatggacaagggacgacggccgacggcagagcatcagcagccgacacatagttcgggtcggggccttgggtggtcctgcatggcccgggactcatctcacggaccctccgttctgcattaagccccaggttctcttctggctttgaaagggcccgagtgctcccagtgtagcttcgtcacatcgtcacgagcccctgtggtcatgggcgacctcacacctccctccctgagttctgctctgacataaggaagtcctcggtggctggtgcagcgcggctgtgctgtgctggggaggcagccgttccttcgggggtccttgggcctgcagtcccctcatactcacccttcacccaacatattttccggtgctgatatgtttccagactccagcgcaacctggggtgctctccagacccgtgcaggggccgcctggggtacacggaaggaagttgagtcctagtgcaaaatgcaggcggacgttgccagagagtgcgcagcaaatgaccttcattgccagttccaccctactcctctcattttttatactaagcaataactttccaaagcaagaagttcaggatggagagagtcccctcctgtgtaggcatggggtggatgcggtgcccacctgggctatgtggggagcaccactgtctcgggatgcgcgaattttttttttttttttaattaacagggcattagaagatgattttgccaaaattgtcatgactctgaattcttgctgtggggacttcctgagttttctcagtttttacatctaagattagtcttggctgaagagaaatgagacgtgattatactactttttcaattgcaggtttaaggagttcagatttaatgaccaaagtcatacagatcatggaatctgtcgtcgtcttatacagtgtcagcctcgagtacatttattaaccttttggggctgtcagttttccactaggattaagattttggccgggcgcggtggctcacgcctgcaatcccaacacattggggggtcgaggcggacggatcactttgagcccaggagttcaagaccagcctgggcaacatggcgaaacctcgtctctactaaaaatacaaaatatatatatatatatatatactagctggggcacatagtggtgtgcacctgtagtcccagctgcttgggaggctgaggtgggaggatggctagagcccaggagatgggtgttgcagtgagctgagaccatgccactgtactctagcctgggtaacagccagaccctgtctcaaaaaaaaaaacaatttttttcataacataattcccatttttatttattttgagtcactcataattaattgccaaaaaagcattttatacattgagttggggggtagtggatcttagtgtggtgttgcatggaggggcgagattttatatttataatcaacacgtgggttaacatgtttttttgaaatccaagcaatacacaggaaatttaagtagaataaaaattgcagcccatttttgaaatgtcagcatgtgctgtgttcagttcaggtttttgttgtttgttttgttattttttaactaataagttggttatcagtggtgggttttcaaaatgtacttgttctaataagttgtacaatgaactaaatcagtggcattctctagataatgtgggggaaggttagaatattttctggccttctatggggtagcaacccagaatcaatctgaattagtcctgttttggtggagtttgtacattttaaatcctataacaaaaataatctagttttcatttccttactagctagatgcgaatttgtctttttgaatgaccctgtcaataagccagaaagggcaacccagaaaaagtgctccccacatccttctgagacttggcctgtgtgtgtggacgagaagccattcaccgtaagggtgcagaaagctcgaccaagccgaattgcaaacaacgttcgttctatttttaaatgtacaggttcgatcgtttctatagaaatgggtttatctaagaaaagtcttggtttgtcttgctgctgtaaaaggcctttccaaacccctccttttattcctgtttcccgaaataaggtatttgtagagttaaggacctactgcatgcctgtccccagggccccggtggaaggaaggcagcgcctgctcttccttaactcagcccatcatctgaaaattcagaagtgaaccaagggttagacgccagaggttgggcttctgttagagtggcttcaaaacatgagccttatgggaagtagccttaaaaaaagaatgggtatacgcagtgacttccgatggaaatctccaaaacaatattcctaagtagcaatggggttggctcaagtctttattaacaaagaacattctctttcatctataaagaaattcttaaagatgcattgacagtgttgaattaccaacagcctgtgaagatcagtttgaccggtgtggacacgtgctggttaagcactcaggcctacgtgggccgagcgggatcttgatcatggggctggtgtatggatccaccgtcggattccgtctgcagaggaggacgtagggggccgtcacacccaccaggcctccctgctgtgctttaacacaggcagaagaggttcatggcaatataatagtcaatgaactttcagtttaaattgtgtacatttttaaattgtaagatttttactgtatattgatgcatagtgtgattcaataaattgcttgtaatttaaaaactatttaatattcaaaataaatatagttatatatttataaactctgttggccgcgtttcttctgtgttttgtccaccgtgcaagggccacctgggtgggtggcctggccctgccctgctgtgagcgcccgcagcctgtgttccaggcccctgccctggtccctctggagcttgtgtgacagacctaaactccccgcactcctgaggacataaagctttgtataaccactggaaaaccaaacctgtttagtgttcctgccaccttgaagcatgtctataaaccatgcctttgca

SEQ ID NO: 15782 - DNA, 1138 bp, Homo sapiens
gcgctctgcccgtggtgccttggatgctggagagtggctctggctccccgaggctttgcctctgcagctgcattgggcatgggatgggcccctgtgccctgtggcagccagagggcgagcagggggctgggtgctctgctgctggcgtgggtggggtgtgtggtccctgggccactcctctctgcgaggagagtggagacggttccctgaacacacaacacacacgtctggccgctgcctggcgtcttggcccgggagacaggataccactcacatgaccacacttcctcctgccccaggtccagcccgccgggctctgtccccctccctgcctggtggcatggcaggaatttgcccaagtcacacatctgttagtccttctgagtgaggcttggccagagaagcccgtgtcccttgtggctctgctgccctggccaggccttcgctgaagctgcctgactccatcttccctttctagccgtttatgaggaagcatttccgcagcctggcggcggatatgtccctgctcctcccaccctcctgcttcacccctgccctgccctgccctgccctgccttgccctgcccaaggcctgggcctccctgaagccaggttctcccttgcccagggaggccagtcattctttgctgggggtgtggttgtacctaggtgcaggatgaggtagctgcgctgggaggctctcctgggctggagcagagcctgcgtcctgcaagcggggaaggcaggagtggggaaggcccctggcctgcaccaggcccccatgagtactggctgggctgtcactgggtatttagttttgggggtgaccagagagagaggaaatcctggaaaggatttcacttttcctagggaaggtgaaaagaacagctgtggagggcggatgtcgctcagaggtccagggtgcggctcagtggccagcgtggaggctgccacggcccttggggggcagaggtgggctgtggagggcacggggtggtgactgtggagcccgggaggggctggaggggaaggagcctgtgacagccttgggcttccagacgatggaggtggaggggctgctccctcctaccacctgtgacctggaagccagagctcccctggttgaggaagtggctga

SEQ ID NO: 15783 - DNA, 1194 bp, Homo sapiens
taggcagcctgccacagcctccagaaccacatgatggtaggggagaaagagaaataggaagtgaggatttagaaacagcattaaaaacaaagattgctggagttcagaatagcaacgttttagatctgtcattttccagaaacatctctgcatgcatagttatttaccttggtgccagaccggaacttgggggctgttttcatttctaggtgaaagctccttggctttgtgtaaccatcgatttactcttaaaaaagaaaaaaaatcctggagctgagttttggtctctacccaacatagaattctaggcgttggttagaatattgactttttagtaagaggagaaaaacggctttttgagaagggaaaattagattcacaagtttcaaatattgcagcaaagtaattcttatctgactttgaaatcttttccataccaaaaaagcatcagtgagatgctcccctgcctgccagtggcaagattcagggcttgcgttttggaagcttctccctgtgtggtcgggccatcacagccacatttcacaatttctttttaactctttctgtgcccctccctcctccccggtggctgaaagcaccagctcagagcaaacgtgtccaatgctgggctgcccggcgacttccgcgaggtgctccagcagcggctgggggagctggagaggcagcttctgcgcaaggtggcagagctggaggacgagaagtccctgctgcacaatgagacctcggctcaccggcagaagaccgagagcaccctgaacgcgctgctgcagagggtcaccgagctggagcgaggtgtgtgcctggcctgtttctctgtctggcagtggcctgattttcaccacttgtggtcagacatgcgattctggttgatggacagcagggattgtgacaccacatgggcctggttcccgagtgtgtgagcaaataataaaggcgactgaacaaggtcatctcaggaatgagctgccagccccactggcattatccagggaaaagtgaaagtgtccaggaccagcttcgataagcaaccacacgggcgtttcagtcctttgttaactagtcctggcagcggattctgtgtatctttctcttctctgctcacactgtggtgagtaagtttctcccacaggagacagagtgggagggatcaggggataattcagattgcgtcat

SEQ ID NO: 15784 - DNA, 1227 bp, Homo sapiens
ggggccacggtggttgaccagaccactttgatgaaaaagtaccttcagtttgtggcagctctcacagatgtgaatacacgtgagttgatcctttttatcattaagaaatgcataaataaggccggatgcggtggctcacgtctgtaatcccagcactttgggaggccgaggcgggtggatcacctgatgtcaggagtttgggactagcctggccaacatggtgaaaccacgtctctactaaaatacaaaaattagccaggtgtggtggctcacgcctgtagtcccagctacttgggaggctgaggcaggaggatcgcttgaacccaggaggcagaggttgcagtgagctgagatcgcaccactgcactccagcctgggtgacagagcgagactccctctcaaaaaaaaaaaaaaaagagaaatgcataaatatgacacatttatctcagctcagatgttgtgtactttgagattaatcgtaacagtaacttttattctcattttccttttctctaccttgtagagaagcaaagtgatgagtaatactggctggagccccaaagaggcacgtgtgtgtgtttgtgtgtgtgtgtatatgcttgtcagtgcatgcacgtgtatgtctgggagtacaaatgggtgcgactggttgtagggaactagctatgtgccttctattaggccatgacagtcaaactgataagatctgattgcttctcttaaattactaaatccaagttttgcattaacataatttccttaacataatttcaattacctgatgcttgttttgccgttcacagctgatgaaacaaagttgaaaatgatgcaagaagttagtgaaaattttgaggtatgagcattatattttctatttttcattttgaggtaaatattcttattcactttcctgtcctgctttgtcagtctttttactagcaactcaaagatcattgtctttgttcaagtaatttagtatatttcgaaactgaaatctgaaactttgtacacagcgttttccatcttcacgctggtgatagcgaaccccataccatgttgaggattgtcagttttgttttggttggtttaaaaacattttttcattttaaaatatggtagctcttttaggctaccatgcctgttgggatgcactcagatttattcttgtacttttctttctttcttttctttcttttttttttttttttgagatggagtttcgctctt

SEQ ID NO: 15785 - DNA, 1227 bp, Homo sapiens; identical to SEQ ID NO: 15784

SEQ ID NO: 15786 - DNA, 1142 bp, Homo sapiens
cagaagttggcttgaaatctcagtggtggctttttatggagtttcttttttttttaatttattttttttttgagacggagtctcactctggcggccaggctggagtgcagtggtgtgatctgcaacctccgtctcctgggttcaagtgattctcccgcctcagcctcctgagtagctgggattacaggcgcctgccaccatgcctggctaatttttgtatttttagtagagatggggtttcaccatgttggactaggctggtctcaaacttctatgtcaagtgatcctcctgcctcggcctcccagagtgctgggattacgggtgtgagccgccgtgccctgctttttatggagtttctaacttcaaggaaaacattggggagttctgcagtttgagggacaagactgttctcacgtgccttcccatctctccttttaggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggtaaggaagggttgaggagtgtcttctgatttggagggtgtctgtacctgagagtggtccttctagaaactgatagtttaagaattgcggccagacgcagtggctcacgcctgtaatcccagcactttgagaggccaaggcgggcggctcacctgaggttgggagttcgagaccagcctgaccaacatggagaaaccccgtctctactaaaaataaaaaaaattagccaggcgtggtggcgcatgcctgtaatcccagctactcgggaggctaaggcaggagaatcacttgaacctgggagatggaggttgcggtgagccgagatcacaccattgcactccggcctgggcaataagagcgaaactctgtctcaaaaaaaacaagaattgcagtaacgtgttgtggtttgttcattttcctctccaggcctgccagctgcccctgttttcttacatcgtggagcgcctgtgtgcatgttgttatga

SEQ ID NO: 15787 - DNA, 1320 bp, Homo sapiens
cccaccttgttaggaagctgcccctgtgggctgttcttggttaaacacaagtcgtctcgttctctccctcacgcaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgtccctagcccc

SEQ ID NO: 15788 - DNA, 1207 bp, Homo sapiens
agtgactttcagaagaatatatgatgaatcacaatatatagttccccctctttacactaaagattatttttatttaccctgtatgctgttttagttgaatgccatgtagcagactgttggttaatatcatagaatgaggtgtgttaatgaatacagttattttcacacacacaaaaatctaataaagaggaaagaaagaagtaatgaatcttcagatctttagaagtcttagaaatgtgtgaatgggtggaaagaatggccccgtttagttttgtaaagtctgtaattataaaacagctcttctacatgacctcatagacaatcccgagtcccagacgctttgcagagaagcatccttgcctttccttgaggcggtgatcaggacatagatagtgggaaggatgtgcctgggaggaaggtcccaagaccacgtctcatcctggcatgccagtgccacccacctgcctgtgccgcagttgtttgtcattgactgggcaaagcagatgacccatgtctcacttgcaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgagtgacatctgaattttttctatccctctctatagaatttacatttgcactgctgtgtgagggctcaccataactccagtttttctcatccggagttgtgtggttttttctctgaaattctcgattctgtctgagcattttcccttctcatgtgcatgttaagttaaatcgcacgttttttatattaacatagagctattgtgtccatgttctgatcgcctaacttgtttcttctgcaagatgctattactgttctcactctatactgcgcaaattgctgttttcttactctcatttacaaataataacattgaaagagtctccgttccctgaggaatattttttctttttttttttttttcacaggatatctatgtaggattcctacagataacaatgttctttttttttttttttttttttttttttttgagacagagtcttactctgttgccc

SEQ ID NO: 15789 - DNA, 1138 bp, Homo sapiens
gggattacaggcatgagccaccgcacccagccttatttatttatttatttatttatttatttatttattgagaaggagtttctctcttgttgcccaggctggagtgcagtggcgtgatctcggctcactgcaacctctacctcctgggtttacgcgattctcctgactcagcctcctgagtagttgggattacaggcatgcgcccccacgcttggctaattttgtgtatttttagtagagacggggtttctccatgttggtcaggctggtctcgaactcccgacctcaggtgatccacccacctaggcctcccaaagtgctaggattacaggcttgagccaccgtgcccagctcatgttttatttttttttaatgagtcaacctctttgcattctgagattccttgtggcagctgcctatggcctgtttctatatacatatattttcatttgctttttccttttctctctgccctttaaacagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcagtgagtatttgcctttcatttggaaggtggggaacaaggggtgggatctctcaccagctgaaccaggactgcccttcctggggtgttagcacagggcacaaacataaaaaccttaatcaggccaggcgtggtggctcacgcctgtaatcccagcactttgggaggccgaggtgggtggatcacaaggtcagcagttcaagaccagcctggccaagatggtgaaaccctgtctctactaaaaataaaaaaaattatccaggtgtggtggtaggcgcctgtactcccagctactcggaaggctgaggcagagaattgcttgaacctgggaggcagaggttgtagtgagccaagatcatgccactgtactccagcctgggcgacagagtaagactccgtctcaaaaaaaaaaaaaaaaaaaaaacacctcaatgaaaactgcagg

SEQ ID NO: 15790 - DNA, 1150 bp, Homo sapiens
caccatgttagccaggatggtctcaatctcctgacctcgtgatccgcccaccttggcctcctaaagtgctgggattacaggtgtgagccaccgtgcccggccgctcacttttaagagtaagagggggtggggcacgatggctcacgcctgtagtcccagcactttgggaggccaaggcgggtggttcacttgaggtcaggagttcaagaccagcctggccaacatggtgaaaccccgtctctactaaaaacacaaaaattagccaggcatggtggcagacgcctgtaatcccagctacttgggaggctgaggcaggagaattacttgaacccgggaagcagaggttgtggtgacctgagattgtgccactgcactctagccagggcaacagagcaagactcggtctcaaaaaaaaaaaaaaaaaagagtaagagaggcctgtcgtggtgaacactctgccaaggaggtgggcggtgggcagtgcatcctccagggactgactgagtcttgtttcagggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcacgtaggtgccgtctgtagagaggtggtcaggtgacaaggtgccttcctgcccctcgctgtttccttactgggttcctacaaaagctctatgcccctcaggcccagacattctttcagggacaagtgcagcaagaagtctgtatcttcccgaccgccaggctctcatttccagctcgtggtagggagggagtcgccaccacctggtcattctgtccttcaaggtgcagattacaaggcagcagccagcaggagcagtgcagaccttgttgcaatctgaggtggtggggcctcagggcagctgcttcctagggtaccctttctcagctactcgagaacaaaaggagacattcctgaatgctgcgttcccacagtagtgcacacataacagaaagcgaagttacagcctgttggaaaaggtaactgtagctgtcgtttcaagta

SEQ ID NO: 15791 - DNA, 1293 bp, Homo sapiens
gcactccagcctgggcgaaagagcgagagtccgtctccaaaaaaaaaaaaaaaatcctgtctagctgggcgtggtagtcttgcttgggaggctgagaagcaagaggatcgcttgagtccaggatttggaggctgcagtgagctatgattgcactactgcattccagcccgggcaacagagcaagcccctagctcaaaaaaaataaaagaggtgggcagaggcccatccagctgagacatgaagggttccccaggaactagaaccttcaaccgacgcccaggtcatccactggtagcaggtctggaatgtgtctagaagctggggtgtagagctttcaggtgcggctccccgctatgatgtcagcagtcagttgacgtcagccccgccctcccccatggcgccctgtctcaccgacacttgaagtcacaggagccggcagccagcagcacattgttggggtgccagtccaggctgaggacggtggagcggatgggcttcttgatgtgcttgcaaacccacctgggaacggtggtcaggcagacagggagagagggacaggcaggtgggactcatggacctcagcaccagggactccaggctcccactgctccctgcagcccaccaaagacccaggagagaggcgactgggcattgccagcccacaaggccgtcagggccctggggcggcagggatgtgctgtgtcgcttctggagtgggaactctgtgccctctatcctttaggccacacagtcaccctcagagcaggctcagcaaagtgatgccatcaccagaggtcacacaactactaactggccatggtgggatgcaaatttgggtctctcagatgctcctggctggcctctgccctcagccatgcaggggagattaaaaactaagacgtggactggcaatcatggctcacacctgtagtctcagcactttgggaggctgaggtgggaagattgcttgaggccaggagttcaagaccagcctggacaacgtgacaagaccctatctctacaaaataaataaataaatgatttgggcctgtagtccgagctactcaggaggctgaagtggtaggattacttgagctcaggaggctgaggctgcagtgagctatgatcacaacactgcactccagcctgagcgacagagcaagaccttgtctcaaaaatatatatatggccgggcgcagtggttcacgcctgtaatcccagcactttgggaggcggaggcaggaggaccacctgaggtcaggagttcaagaccagcctgaccaacatggagaa

SEQ ID NO: 15792 - DNA, 1223 bp, Homo sapiens
gtccaggaagggcactgctctccctcccctccgcccacatctgtcaagtcccttttcacccctctgcaaacataatgggggtgccagggccaggtcaggcttgctttttgcctagaaaagcaaacagctgcaggggtctcccctagagcaggtgtaactggctgggcaggacagaaggcgcctgagctcccagggagtcccaacgctggccttgctgggggaggtggcagcccccagcatcacccccggttttgatacacctgcaattcgggcctccctcgctgtggcccgtctgtatccttgagctggcatctgcctcccgggcggccagacgcccgcctggccttccctccggcctcggtttcccctccgcggcgctccaatggcccccgccctccgcgcagggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcaggtgagagcgggagccgggccggcgggtgggcggggcctcggctcgcccagaaacagcgtcgggtgaggaaggggcctggagtcttcctcctggggcattgtgctgggaccttgaggactggggacccggagggagggtaggcgtgccctcaactcgctgcgccggaacggcgtctgatgagcggcgggcccggacacgaggggacggggccgatttgtgggcggggccttggcgccgtactaaaaccgcgtggggcggaggccggcagaggtcgcgtagcgggcccagggtagggagtggctttgactcgctgcggaataacatcgttagttgtgggcggggcccatcttgatctcaccatagcagcccaggtgctagtggagcctgggagggacacggtgcgaccgacataagacggggtcgacctctttaggttgcataaaaatagcatcagatggggctgagcagctagcctcgctctgcatttccgggacttaggtggggactgtcgtagggctggcccctacggttctctggggtggccaggcagtgaccagcgggcttcctgggcggggtcacagctggggcgggtctattgctagcacttagcgag

SEQ ID NO: 15793 - DNA, 1231 bp, Homo sapiens
gcccctacatgtccatctgtcctgcctcctcaccagaccatgaggaagcaggcctggaaaggggaaaccaattgctcagggacattgtcacccgcaccagaaatccagtgatcccaacttcccattcaaccctgcttcacaaaccccaagcaggaaaggacttcacatgtaactgttggaatgtttaaattttagacttcagaacccgtggagggaggttagaattacagggttctgctgggaggtggggtgagaagtttccgtttgcccacaagagtgtgtgttggtggggctttgtggaaggaacagctttctataaggtggtctggccactgaagcgtgtcgggaatgtcggggggcccggggttacagctgcagcagaaatcctctcccacgcctcggctcttctctgttgcacagaatgttttctgcagcctttcagacctaaagttctagggttctggcacgtgtgttgggagggggtggggggttgctttgttttaacccctgcccttctcccacccctcagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaaca

SEQ ID NO: 15794 - DNA, 1168 bp, Homo sapiens
cagagcagtcaaggcagctgcttccgctcacctaaactgcgggtctctgcaggaagaaagggaggccacaaaggccgggcgaggcagtatacaagccctgaggagatcgacgcgcagctgcaggctgagaagcagaaggccagggtgagtacgtgcctgtccaggccacgccagtggcccagggtggcgctttgccaatttggttcatagagaggccaggcaaggactacccattcgcagggacaagccagcacgtgggggtcgggcgggcagtgagccccaggtgtgagtctcagaacaaccaatgacagtcagggcgtgggcatcctctgcctggatgggttagaaagaactgtggctgctctgcagcagctgctttagtggggccctgttcttggtcttgtgcacctactttcaggaggatctccctcctgcaggacctgtccattcacagctcgagctcccagcacccctgcttgtctgctgcagccacacaggatgatttgccacactgcacatgacatatgccctgccttcccacacccccagcatcagcatgctctccatccctggagacgttgtttagcctctcctcctctgtgactcatgcctcacctccagccagagctgatttagtagttccctctcctctgctcccatagtacattgtccaggccaccgttaggaaatagaatacattcccatcgtcagcatctgcatcttaccatatcattagattgatgcctggatcaagggcctaagggagcagtcagggccagatgggtacacagctgtgacgtaccccaggagtctcaagaagggaaaggccacatccagctgtggggtctgggaggggtccttgggggagccagcagctgagcaggacatggagaatgtgtgggcaggtgccaagaggtgaagggacatgaggttcctataagggacatttttggtgggaaggcaagaaaggtggagggaagcagccttccgaggtgttgttctggggagctggtgcaggaggtcacctgtgtgggtgggtcggggggatgacttgccatggagtgggagtggagtgcggagaggactcgcctgggaatgccagcatgatttggcagctgcatgtggcaggtgggagctgagtaggatggtggttttcagcctggtggct

SEQ ID NO: 15795 - DNA, 1131 bp, Homo sapiens
atggctccccgagtcacagccctccttatactctattgtaattgctttttctcttgtctgtctctttgctaaaatgtcaccttctaaggggcaaaggcttaacttttgttctgtgttcccaacatccagtatagggttaagcttttagttgaagttagctaatgacaacagcaaatgtctcttaggcacacattatacaccaggcatgatagatacaattctaatgaagtctttgcaatgaccacataaggtagcttccattatccccattttacagatgaggaaacagaggcttaggaaggttaagtacctttctgaagatcacagcgggtaagtagcagagccaggatttgaacacagtctgggtgctgagccctgtcccatagctgtgaccctatgctgactcaaggaagtcagcctgtaccgaaataatggctggcaaaggcctttggggatttgagactcagaaaccaattcatttttttcccccagatctttgcagattatcctgtggaaggaaaatgcctaaagtcaaaagaagccggaaagcacccccagatggctgggagttgattgagccaacactggatgaattagatcaaaagatgagagaaggtgagtaggggagttcctgtctgggtgggctgggtccaagggtcacaggcttagatgcccccaggggacaggcataaatgcaaatataaaaagagagtggtctactaacactgacatgttgtgtttgcttatgaacttggggaaatactgtaagtgcccgaaaataagataacattaatgaaaaggtcctcagaaaaggtgtttttttttgtttttgtttttgccaactcgaatataaaaggttatgaaatatagatcaaatagtctacctatagttatttactattttggttagatatatatttaaaatcatacaaaatatatttacttggaagtgctattccttttcagtatcatcgattagtctttgccgcatctgttttctgtcacttccttgtaaatggcgtgtgatcctgctttgtgaacccgtgtcctatgctgtctttggaaattttatctgaagccacaagcatctgttggccttatatgatcacagtgtggccacttaccaattga

SEQ ID NO: 15796 - DNA, 1206 bp, Homo sapiens
tgggcactcccttagttgaaaactgcatttgaacagtgttgttgtctgtctctcctcttcccccacttcctgctgttcccagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaagccatgtctcattaattaagggtctcatgccaacccttttacactggctgcaatcacggcgtagctttcttgtccctttcaacaaatgtcagcctcacaaagggaagtgcagctgcccagaaggcctgcaagcagctggtcaagtctgggagtctgatctgtggagccagcaggcaggtcct

SEQ ID NO: 15797 - DNA, 1275 bp, Homo sapiens
atgcagaaagagaaatgagttgagtgggataatctggtaccccagaaaagcatggctgttccggctctgaggcttgagaggagcttgtctggtgggagattggcgggaggtgtcggtggcagcctctgactaggctgtttctgacagtgtagtgtacaccccctacccccacctcactcccattctgtggcaccagggcggtcctgcctctgaaggacgggttctctggggctgtttgtctgagcgtgtgttccctctgttccttctggaaagaaagtggttggccaggtggcaggttggctcctgaggtgtctttgtgccccccgggtctgctgattctgcagagacaccggcaggcgggtcatgggtcatctctgaagggaattctcaggaaggctttgtgtgatctcagcctgcttcctgccatgctgtgccttcactgtaaccttttaagatacttaccatcttgccttcctgacttcagagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgtgctgattgcctgcctgtctgccgtagccattatcccatgttccaggggctcctgtggcacaaggtggggggaggtcgtctttccaggccgttgaccggtgaaggcctttgtggacttcccagaccaccactctggtcgtgtcccagctccctggagggcagggtgtcatccagaccttcccgaagcagcagtgccgaagtccgtcccttgccatgagtgctgtgggcaggtgcatttgcagacattctggcctttagttggctggccctttatggtgtaacacaaaggcttgcgtacctgagagcgccagatcccaccccggctgtcctgtggctccaggcagggatggcccgcatcctgtgtttctgcatcaccctggggcatcaagggctacagggtgaggtgacccggcactgtctggagagacctcaggcagcactcacgcccaggctgcagggattgtggccctccggctgaggcggcttctctaacaggaggcttagtgggttgggggtgatggggaaaagtgaggggctatggcggcccctccctgcttcctcttcatcagagcctcattgggggtgggatactgtgccccagaaataggtgccaccagacatctgag

SEQ ID NO: 15798 - DNA, 1262 bp, Homo sapiens
gaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccacctgtcctcccaaagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacacctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcaggagaactgcttgaacctgggaggcggaggttgcagtgagccgagattgcaccact

SEQ ID NO: 15799 - DNA, 1816 bp, Homo sapiens
agaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcc

SEQ ID NO: 15800 - DNA, 1232 bp, Homo sapiens
ggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttcagaagagattgagtgtggttttgtgcaatgtttggaccatatatttcagttaaaacaagacatgttggctgggtgcagtggctcatgcctgtaatcccagcactctgggaggccaaggcaggcagatcacctgaggtctggagttctagaccagcctgaccaacatggagaaaccccgtctctactaaa

SEQ ID NO: 15801 - DNA, 1221 bp, Homo sapiens
gaggggattccttggaagtggggttggaaggtgtggccacatcccgtctcaacctcctcctgtcctcatccccttgcagtggctgaacacctgatagcacagcacagcgccatcaagatgctgcacagccgcgtcaagctcatcttggagtacgtcaaggcctctgaagcgggtaggacaggggcttccctggcattcttcctctccctcctggggaagtgacagcatccaaactaatgtagtctctttttgtgcctttaggagaggtcccctttaatcatgagatcctgcgggaggcctatgctctgtgtcactgtctcccggtgctcagcacagacaagttcaagacagatttttatgatgtgagtgtaaaacccggatggggaggcggggcttatgctgtcactttcacgtgcaggactggggactgttgttccccgggcatgccacgagggatcccgaggaactggtcctttctgttccctcccagcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactactttcctgagctaaattaacttgtttttcacatacgcaaaaaagaagggatagtaagcagatttttattagaaagaagtccaagccttgatcctgtgggcactgtgaattaccaggagggagagtttctcaatgaccgtttactacatattttggagaggcagctaggaagtggtctaaaggttgggattgctg

SEQ ID NO: 15802 - DNA, 7789 bp, Homo sapiens
tgcactgccacgggctctttattcttcgctggttagaaacagacttgtgaaaaagagttatgcccactttggggagacttcggtaggtttatttaaatgctcatattattaattagttcataggtcgtgttttaagcgaaaatgggtatctaagatttgtcttaaagtttgtgtcttacggttttacatttcatgttacagaaaaggttaagaagttcttacaagagttctaccaggatgatgaactcgggaagaagcagttcaagtatgggaaccagttggtaagtctaagattgggtaaagggaatggggagcggggtgcttaaggagccataagcagcagcttggcttgttttattaaagacataacaattagagggtttgagggctgaaaagcgagtatcgctctgtgtggcgctgcgttctcccctgtggatgcccagagcctgtgctgagttctcagtgatgcattttcacatatgaacactggtgagcaaagtgaatgtggctctgaggtgtttctgtctcttccccacttgaggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtgagtggttagagaacaatggcaaacaaagggcgaggcgtttaagcttctgtagagaggctgctcagatactgatgttttctgagcaggcagaaaggaggggcacttctgcctggtgttctctgtgctctcctttccccatcctgttgctcttttttttttttttttttgttcttctcctttaggtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccggtacgtgtggagcaagaagcaggaaagcacttacccattagttgttttgtagagattaatttgatcctgtgatgcctattgttttatttggttgtaaaagttgcctgtgtgttcgcctttcattcttgggtatgtagtggtctttctacctattttctgggtgtttgttgttgacccagagtaagttcagagggttcttgacacttacaagatgtctgccatgaagagaaaatgtgattcaaaggaccgacccaatggggctcttttccttctgagttcctttggtgtttctgttctcacatcctagatccagtctcccactttcatgcctctgatcatgtgcccaagccaggagtgccaaaccaaccgctcaggagggcggctgtatctgcagacacggggctccagattcatcaaattccaggagatgaagatgcaagaacatgtgagtttggggtacgtggccctgggcaggtggatcgggagtccacttgaatcctgtagtcacttgtggaatggcaggaagaaagaagaacaaaagagggaagtgcaggagggaggtggaactagaatttcctgggagccttgggaaggggaaaggaggtctcagcacccctgctgtgggcttgtctgtggctgggtagcctgggagcctttgagtgggatgcctagggagggaaggttgggtccttgtccatttctcctagtcttatgtgcctttccctcccctagagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacaggtaaggaagagtttgacatgaggaatggatcatccccttttccctcacctactcattctacccacacagagaaaagagcagcaaaaccccaaacaaaacagaacccagggatttgtcaagaaattgttagggaatccagtgatgggcaagttgaagggattacatctgtatcctggcattttcctgcccaagggtttactctcagaaacctacctggaagcccatcggattgtgaagatgaacaagagtgaggatgatgagtctggggctggagagctcaccagggaggagctgaggcaaattgcaggtgaggggcaggggagagagaggaaattccgtttacatcctagctcccttttcccccagaaaataaaacaaccttaacttctctacagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggtaagaagaaacaagggagaggctcagggtggatgaagtcatttaggaggaaaaaaggatgacaagtgtccctgtaggtcacagtatgagtggacatcttgccttcgtggacacagggagggcttagaaatagtgctgggtgttaggggtaggcagaactcaaaattgctctgttgttggccaagcactgggagaagagtcattccagggctgccttcccttcctccaggcaacatcaacatctgtctgatgggggatcctggtgtggccaagtctcagctcctgtcatacattgatcgactggcgcctcgcagtaagtagttgggctttgcgggaggtgaatatagtgacagacaggaccacagtgtttattcaaaaagtaggggtgcatgtttgctcacgcctgtaatcccaatgctctgagaggctgaggcaggagaatcatttgaggcgaggattttgagaccgcttccatgtctactaaaaagttttgtttttgtttttgttttttttgagatagaggcttgctctttcgcccaggccggagtgcagtggcgctatctcggttcactgcaagctccacctcctggggtcacgccattctcctgcctcagcctcccgagtagctgggactacaggcgcccgccaccacgcctggctaattctttgtatttttaatagagacggggtttcaccgtgttagccagatggtctcgatatcctgacctcgtgatccgcccgcctcggcctcccaaagtgctgggattacaggcgtgagccaccgcacccggcctaaaaagttttttttgttgtttgggtattgttttgttttttgttttttttgagacggagtctcagtcacccagactggagtgcaatggcatggtcttggctcactgcaacctctgcctcccaggttcaagcaattctcctgcttcggcctcccgagtagctgggactacaggcgcgtgccaccacacttggccactttttgtatttttagtagagacagggtttactgtgttgggcaggctggtctcgaactcctgacctcgtgatctgcccgccttgttatcggcctccgaaagtgctgggattagaggagttagccactgcgcccggcctctactaaaaagttttaaaaattggttgggtgtggtagtgagtgcctatagtctcagttacttgggaggctgaggccggaggatggcttgagcccaggagccaaggtttcagtgagccacagttgtgttctgaagagaaccagtgggaggggaagggggacattgccagtgccccacagatcctcgggcatctcaagaaggcctggtggagggagtggaatgatcccagcgcaggcctcgcctccctggcccgtttgttgtcttttgcttgttctctttcttgttctttctctctcatggttccttatttcttctcttccaggccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggtgaatgaagctcaacacccaaagagaggtcccctgtaatgatctgtgtagggaggaggagaggtgaatcagaaaacaaattccacgctcctggaaaccccagagcctcccctttgcagcaggggctggtccatggttctcagggaaatggtgggttggggctgaaatgctgatgaggatttcccgggaaagcttgtccctcctacactgtgaggaagtggcagagccaaaggagggacacctaagaggacatgggtgcgtagccctaaaaagggtgttccttctaaccttccctctgtccaggttggcccagcacatcacctatgtgcaccagcacagccggcagcccccctcccagtttgaacctctggacatgaagctcatgaggtaggagagctgggtgcgggtgggcaaacgttggcgtgggccgtgcgagcctcctgaaaaagtgcttattagtcttagggtgtgtgtttttcacaccaccacttcccgctacagacatgtccagagcctcagatcagcttttaagtggaaaattccacacttcatatcatagggacacaggaaattttgtttcctacactatttattttttttgagacgaagtcttgctctgtcacccaggctggagtgtagtgatctcagctctctgcaacctctgcctcccagattcaagcgattctcctgcctcagcctcctgagtagctgggattacaggcgcacgccaccacgcctggttaattttttgtattttagtagagagcagtttcaccatgttggccaggatgcccacctctgcctcccaaagtgctgggattacaggcatgaaccactgctcctggcccacaaaaatatttttaataaaattaccttcaggttatgtgtatcagttgtatatgaaatacaggtgaatttcatgtttagactggagtcccatccccaagctatctcatgcatatgcaaatactccaaaatttaaagtttaaaacacctgctcccaggcattctggatgataatctctatcgctattttcccatgagcctccagtgttctttccggtttttactcccttttaaatattctgtaaacagttctctttaaataaaatatatgttttgccatgtcatgcgctcagaggaggggtctggatcctctcttaatgacagacggatttgtcttacaaaggccattttcccgaaaaaaataggaaataacttggaggatactggtgggggctatacgtttggtgaaatccatcagtgatattcaagccaagcaaataatcacccactaatttgtgttttccacttaaaattcttggaggggaccatgttaaatggggagccctggtacagaaaacaacatgggctcatattcactcccttccccatctccctcttctgcttccccatgaaccttcccccacaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggtaagtgcccaaattgctggagggccatctgttttgacccttaaaggggtagctccttaccgtgctctcattgccgcctccccacctcccgctccagccctgccggggctaaagtgctgacagtgcagatagtggtcctctccgtgctaccgcactgtgggtacttgctgctccagcagggcacgcacagcgtccgtggagggaaaggccttttccccacttcttaaccttcactgagagggtggttggggtctgtttcactccatgtgtcctagatcctgtgctacagaccttcctttctgtcctcccgtcttggacctcagtcctgggggctccaaagtgctgttcgtgcaggtagtgtgattacccaacctactgctgagctagcacttcccgagcccccgggacacgttctctctgccaattgtcttcttggctgagctccccaagctccatctgtcatgctggggagcccagtggcgttcaaaagggtctggtctccctcacaggacagctgaactccgggactggccagtgttgagaggcggagacttgggcaattgctggacgctgccctgggcattgcacttgtctcggtctgacagtgccggcccaacactgcggatgctggggggaggggggattccactcctgttttgtgagtaggcgacccatgggctgcccagccttaaagccagaacaagggtgtcccctgacctcgttccactgccctcctcccgttcccatctttcccccctaccttccccttaggcacgtctgagaatggtggatgtggtggagaaagaagatgtgaatgaagccatcaggctaatggagatgtcaaaggactctcttctaggagacaaggggcagacagctaggtgagtggtttagtgaaggacaaagctgtgtcactttgtcttctgtggccatgtgtctgaggttggcctcaattctaacactggccaccattgttctctgttgatgtcgagcattcctgtttgtatcctgaccttacacacccactcatttccttcaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtcatcttctagcctgggcctgacttccattaaaacagggttttgtgcgttttttagattcctgttcgtttttatgctatttcatccactcagtaaattacctgagtaaagtgcatctccctgccaggcccccagtatagacactggggatgcggcaaggactaagcggtccctgctgtttggagatacttaagatggggctccactttttgagccccccgactcccttatttggtcttatactgcctgtgtgcaagtcaggctctggggatatggcg

SEQ ID NO: 15803 - DNA, 7789 bp, Homo sapiens; identical to SEQ ID NO: 15802

SEQ ID NO: 15804 - DNA, 7789 bp, Homo sapiens; identical to SEQ ID NO: 15802

SEQ ID NO: 15805 - DNA, 7789 bp, Homo sapiens; identical to SEQ ID NO: 15802

SEQ ID NO: 15806 - DNA, 1160 bp, Homo sapiens
gcctctactaaaaatacaaaaaaaaaaaaaacatagctgggcgtggtggcgggcgcctgtaatcccatctactcgggaagctgaggcttgagaatcgcttgaatccaagaggcagaggttgcagtgagccgagatccggacaccgcactccagcctgggagacagagcgagactccctctcggggtaggtgggggtggggaaaaaaaaaaaaagagtcaatgggcgccagcaacacaccaggcccagctccctgcgtgactccatcctcagcaactcggggtagttagtgtaattaaccccctttccacattgggaagctgggcccaggcatatgtcatgtatctcccaaaggcactgctgttgtgactagtaagaggcatcgggatccgagctcaggtctcctgggttctgatcactccacctccctttttttaacgcctctcttctccctgcctgtgtctcagcatcaccatggccgtcatttcattcacatcagacacagcggcctctatttggtggtcacaacttcagaaaacgtttctcccttcagcctcctagaactgctctccaggtgaggagggttgggctgggcacctggtagctaggaggggtctgagaggaggagaaaatacacgctccaagtgtttcctcaggttggccacccttctgggcgattactgtggctccctgggcgaggggaccatctcccgcaatgtggctctggtatacgaactcctggatgaagtgctggtgagaatcaacaatccccttctgtggcccctacccaattcccctgaagatacatctgctcttctactgtgggatgccgtggttaggaggccaagtctacctttttttttttttttttttttgcttttagagacagggtcttgctctgttgcccaggctggactgcagtggtgcagttatagctcactgcagcctggaactcctgggctcaagccgtcctcctgccccagcctcccctgtgcctagctaattgtttattttttgtagagactagagtctcactgtgttgcccaggctggtcttgaactcatggcctcaagccattctcctacgtctcggccttccaaagcgctgagagtacaggagtgagtcaccatgcctggccccactccccctctttaccccttcc

SEQ ID NO: 15807 - DNA, 1146 bp, Homo sapiens
ggaaacgatctacaagaactactaccgaatccaattgaagccagagcagttcagttcctacctgacatccccagacgtgggcttctccagctatgagcttgtggccacaccccacaacacctctaaaggtaaggctggtttattttgtcagggaggctggtcctggctgaaagagtgcagacccccatggggattcttgaggtgctgccaaccccttctgatcactctctctcccctcaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggcccccacacctgtctcggtactgtctagctggtgggggatgggtggtgcctcccaccagaacctgtgctgtttatcttccatctcaaggaagacacgtttttcagtggttgagctgattgttgaacactagtcaagtccacacgcaagtacacagaagcctagtcaggaaaaggtgtgtaatgcaaattttggtgtggaacttggagtctgccttccctccccagaaaaaccccgtagacgttttgggcagaaggctaactttttggtttttgtttttctgagatggagatttgt

SEQ ID NO: 15808 - DNA, 1229 bp, Homo sapiens
ctttgatgctgcgaaggccgtggaggaacagctgagaaagtcgttccagatccgctgcggcctggaggagagcgtgtccgagggtgaggggggcgggcggccggccgcgtgcgggagtcggggtgaggcgcgccactcacctccgtccccgctgcgctctcagggctgaacgtgccgcgctccaagcggctcttccgggacctggtgagcctgcaggtgccggaggaacaggttctgaatgccgcgctcagggagaaattggctctcctgccgccacaggctcgagccccgcacccaaaggtgatggggtctgggcgtggggcttcctccatgtacccccttacccggatccttcctcccaaagtgtaaccttgctttgggcccaacctcccaacaggagccacctgggcctgggccagacatgaccatcttgtgtgacccagaaacgctattttatgaatctccacacctgaccctggacggtctgccccctctccgacttcaactccggccccgcccttcagaggacaccttcctcatgcaccggacactgaggcgatgggaagcgtagaccccaaagatccctggagggctagttcgtatttttgtgttaaactatttgttagaataaagtaattttgctaataaatgggactcttcttggaggcctaaaatggggttaaaagctctctagggggttatccacttagcctcaggttggaagctgcctggaagtcgggtttgggggcctttttggaacttggtagagtcatggcaagtggaaaacactgtccacgttagaggtttacttagatacccctccgttcacaaccttacctgcctctccctgacttcagccacagctactgcctgtttttgatcaggtagcgattgttctctgcatcacttattctgatctctcaaaatgcagagcccagcctatcacacttcacgaaaaccttccatgattacctgtctcaaggagcttgcaagccagctgtctgcactgagttactgaaattatctccttgctttttacctttaagagccttgcccatcctgtttacacctgacctgaatactcagtatgttcgaagttccagtaacacctaacaagcccccgaagagcttcatgttgttaattgcctgtaagtctgattccacagcacaaaaaaggtgctggcccgtccctgggcatttgatccaaagcacttttgcctacctccacc

SEQ ID NO: 15809 - DNA, 1195 bp, Homo sapiens
gcttggacaacatagcaagaccatctacaaacaacttaaaaattagccgggcatggtagcatgaacccatagtcccagctacttaggaagctaaggcaggaggatcacctgaggccaagagttccagaccagcctggacaacgtagtgagactccatctctacaaaaaataaaagataattaaaaaaaaaaagtagatacatcttccttgttcaggcttctccctggaggacctgggctgggcaggagtgggggctgcagcatctgatgagtcttgtttctcagacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggtgaggacagtagtggccagggacccaggccccaggaaaaagggagaagggacgggaggagagctaacagagccccagggctgcccatgcgaccctattctttctttgtcccccctccaggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaatgtagggtacttgcccctgtcttcccacttcttttttggtactcagacatcctctagttctcccacccctgttcccaggggacccaggcacttggggcagtgatgaggcccagcgaggatttagaagagttaggtcactcctggtgcttgcgctgaaaaactatgtgaccatgagcaaattatttaatttctctgagctgtagattctacctacaaaatgagagcattgggcaagttgattctcaagatccccttcagccctggaataggatcctgtccctaagccaatgtattaacctaaaaagaaatgaatgaaaataccacctaatcctgcctgcggtggaactcctgtcccaccatctggaggcaacaaagcctttcaccagggttacc

SEQ ID NO: 15810 - DNA, 1309 bp, Homo sapiens
ccatgtgccgacagaccttcatcggccatgaatccgacatcaatgcagtggctgtgagttttggggcgagctaggccaggccctccccaccaggctcccggccctgctcctcaccctcaccctcaccccatctgggtcccgtgtcctgcagttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggtgacagctggggcccaggctgggtgggcagggacctggagcccaggcccaatgggttctgacttctctcttcttcacaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtacctggtctctgcccttgctgtgttctccttgtttctggactttgttgcctgagggctgctgagggggtggatggtggggaaggtatggggcctgccaggcagctggggctgggggtggggtccccactctccctcagagcaaagctgaagccccagcccagagccttccgtccagaggttctcggataagcagccctcaccatggtttcccccgtcaggctgctgaccagagccagcctgaccaggcgggcactgctcagagctcctagttcccagctctgtgcagagccactcatccccatggctctccccagataacgagcagtggaggcggaacgggagaacacacaccaagttttattgggagaagggagtatttacaggag

SEQ ID NO: 15811 - DNA, 1174 bp, Homo sapiens
cagctggctgggtggacaaccctcgccaggtcccctcaccatgtccccctcttaggtgcggcagcaggagctattgctgaagttgctacagcagcagcaggcggtccctgtgccccccgcacccagctccccgcccccactctgggctggcctggccaagcaggggctgtccatgaagacgctcctggagttgcagctggagggcgagcggcagctgcacaaacagcccccacctcgggagccagctcgggcccaggcccccaaccaccgagtggtgagcaggccgggaacctcccgggctccccctacagtttccagggtggcacagggagggggatactgaacccagacttgtgcagccccagccccagtcccagcctctcctgtgatggcaacagctcttgtggccctcacctcacctgtctccctttgccacctaaacaagcctccccatccgcttttctggggtgcctttgtttgagccactctgatcttctgccatctgtagcagcttgggggcctgggcactgcccccctgaaccagtgggtgtctgaggctgggccactgtggggcgggccagacaagagtgggggcggcagcagcggcctggggctctgggaggacacccccaagagcggcgggagcctggtccgtggcctcggcctgaagaacagccggagcagcccatctctcaggtgggcgtggcacctggaggctccgggatggccctgagggggaaggtggcagacccccccaacccctgccagctgatttccaaccctgactcaccctcccccttcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacggtgggcgagcggctcccaggaggtgggcgggacctgggtctccagacccggccagggggccctgacagccttcgctcatcctgcagtgcccatggctgtagcgatcctcaaggaggtggaatccccctatgatgtccacgattatatccgttcctgcctgggggacacgctggaagccaaagaatttgccaaacaattcctggagcggag

SEQ ID NO: 15812 - DNA, 1217 bp, Homo sapiens
gaaggatgttgaaagtctaacaaatgtaaaatggcttcaaactcacagaataatgcttgcgagtttgggatggttactgctaccgtgcgcacctccagtcttgcatagtgtcaaggatgtcggggcacgctgtcggagcagcttcctccttcttttccctggctggagcccaaggctgggcaagtgggcaaaagggatcacaggaggtaaagagtgaaaatcctttgaaaactgttaacttgtagacaattgccaagcggtggtgtgatttgctgggatggctcagagaggagagagctgggataaccgaccagccgcgaagaatgcgggtttgcatctcttttttaagcctcagcgtcctcaccctaccacgcttggagaatctccatcctgagaaagggccaggtcccctccagcaggcctggggctgggcggttgttccagtgttgaggaattggggactgtgcttctgtttaagtggctctgttctgtgccaaggcacagtgctctgtgttggagctaattttaggggtgatggagtgaggagataatgttcttagctgaatgtgcactgggaccgcctgttctctgtcttttctttctctcttgagttctgagccccagagagcaggctccctttcccgcgcgccctggcgcctactggagcacccgggcccagcgtgtcctcgccccttgtctccggcagggggcagtctttcaaaagcattgattcagatgctgggggagtgagggtagacaggcccgagaaagagaaggggtggggaaggggcgaggagccgaagtaggccgaggcttgagggcagggccagggcgggggacaggctggaaggggcctgtgagaaggagaccctgagctgagaaagctcagccgggtaagctgagacgggcaggtggcagtaccccagcccccgccacctcctgctcttaccttcattggacagggatcagatacctggccctgagagcttgcaatagacaaacttaggcagtttttcttaaaaaaaaaaaatctattcttttctcaaagattttctcctggcaggatttcagatttccctcgtgggacagtgtaattagggaatgatgtccctgctgttcagagaggagaatgacccagcgtgcacacacctgccttcccttgccttccccttggcccagtagacccccaagggctgtgcccatgctcgtggcgcaga

SEQ ID NO: 15813 - DNA, 1219 bp, Homo sapiens
tttgtggttgtgagaggaagggggatatgccctgtctttcctgggccccttcccacatcctggccttggcttccaataactgttttgtctttccctcccccgcttcgttcccaggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcaggtgtgcggatttggaggggtggcaggcatctgggccccatgggggtgggggtgtctggggatcaggtagaagccggttgacaggagccagggccctggggtcatgacctctgttccctttgttggtagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggtccgagccctgggtctcctagtgttgtccctggcagcctgggggaggggggcgggtaggggtccataggagctagaagtagggggctggggaaaatgaacctgtggcctcagctgtgggggtgggggccctctgataaaggtgggaggggaggtttgacatccccagtggttgtctcttaccataggctgagaatgacagttctaatgatgacaaaacaaagaagtcggagggtgatggggacaaggaagagaagaaagaagactccgagaaggaagccaaaaaggtgaggtgtctgtggcctggggtcagagtgttggggctggggttctggcacgctgacttgtcccctctgctgtggctcacacagagtagcaagaagcggaaccggaagcacagtggtgacgacagctttgacgagggcagcgtgtcagagtctgagtcggagtcagagagcggccaggctgaggaggagaaggaggaggccggtagggtttcttttctgctttaaagtgcgttctcctaatgcgggtggggaggtgagaggttggcgacattgacgggagggtgggtggcttttaggggaaagcttctgtatcctccccaccacaatcagtaataa

SEQ ID NO: 15814 - DNA, 1190 bp, Homo sapiens
acatcaacggcatcacccagcacaagcagattgtgcgcaacgacatcaagctggcggccaagctgatccacacgctggatgacaggacacagctttgggcctcagaaccagggacgcctcccctgcccacggtcagtgactccccaaaggactttgtcagaagcaactggtagtgcctctgctgtgggcacctctgaccttacctatctgtagccttgaacccttgcacccactcgcctgctcactcatttgccccttcgtgtgtgggtagcagcacctccagattccagcagaactggggggatgctagtgatcatttgtggctggggtggaacaaaagctaaaataaagacaaatctcaagggggcaaaaggtgccatttatgtccggtgaactcctgtcccctcgctgctctttcacttgtggaaagtctcaggttacctcctctgaaggtcttctctgccttacttgcttctcttcctcccatcagagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtgccagtggcagcgcggggcacgtgggggctcgggcggtgagggcaggagctgaacgctcgcattcacttcccttaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaaggtgagctccaggttcccctttgttcccggctgcccctggccttggtcctccagccccttgccaccatccttccttctggctcccttgccaaccttccttcctctgttcccaaaccacagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctct

SEQ ID NO: 15815 - DNA, 1167 bp, Homo sapiens
cgaggagtttgagtctgcagtgagctatgatcgcaccactgcattccagaccccatctcgaaaaaaaaaaaaaaaaaaaaaaacagaaacaacagaaaaagcaggttatccatcacttctcagctaagatcaagtgttaaaataaataaataaataaataaataaataaataaataaataccaagttatgagtgtcagagcaggggagccctccacgcagccacggagccagtctgagggaagaggtacataggatagaaaaatctctaggctccaacgcttctgcttcggtgtctttccatttcccagggtctatgtgttgccttctcttcattttccagcaaaattccttttgagatatgttggccttcactcggctgaactagggggtgaaggaaggttgtcctctgtgggccactattgctggggaaacagctaaaccctgcaggccaagtggaacttggaggtgccaagaaaacctagaaggtgcaatggggctgcgacggatagaggtgtcaaaccagaagggaggaacccgtcggaggtgggctgtgaccaccggaccttttcataagtggtggcagtggtagaattgagggggcaagtaggcttggagaatgtttttagccaggggctgttgagagatggcagaagggggtcttaatgtggggactgtggacagtggggcattcgtgggaaccagagggattttggacaagtccagatggaatgtgcagggcataggtagagggaaaagaaaatccctttctgggaaaaccatttcttgtttattgaaacaatgcaggacatcatcaaagtccgggtggacacattccattatctacaaattacaaaggtaggcacagcaaagaataatgaagattataagaaaaccaagcgccaggcacggtgactcaagcctgtaatcccagcactctgggaggctggggtgggtggatcactcaaggtcaggagttcgagaccagcctggccaacatggagaaaccccatctctactaaaaatacaaaaattagctaggcgtgggagcgggcgtctgtaatcccagctacttgggaggctgaggcaggagaatcatttgaacccaggaggtggaagttgcagtgagctcagatcgcaccattgcactccagcctgggtaacaagaa

SEQ ID NO: 15816 - DNA, 1118 bp, Homo sapiens
caggctggagtgcagtggcatgatcatagcttactgtagctgctgcttcttctttttttttttttttttttttttttttgagacggagtctcgctctgtcaccaaggctggagtgcagtggtgtgatcttggctcactgcaacctctgtctcccaggttcaagtgatcctcctgccccagcctcccaagtagctgagattacaggcgttcaccaccatgttcagctaattttttgtattttcagtagagacaggtttttcccatgctggccagcctggttttgaactcctaacctcaagcaatcccgcccgccttggcctcccaaaattctgggattacgggcatgagccactgcacctggccaagtatcatgaatctttatgtttactttaaatctgctgacagcctggttcatctgggctcactgttttggccatggagaataacatctgaaccagtaactatgtgaatattccagaagtttggttttcagagtttgacaaacagccatcaccttggctacagagataagtgagaaaggggggaaacagacctgttgtattaactctttcctcccactcttgaaaaagatatctccagacccagatagtttcactggagaagtctactcatagttaaagaaatatcgacactaattacacgtaatctccagaaaacagaagaaggaccacttcctgactgacgaggccaatacagttgacccttatagctgcaggttccccatgcatggattcagccaaccacagatcgaaaattttccgagatatggacgccaggcgcggtggctcatgcctgtaatcccgagaatcgtttgaacccaggaggcggaggttgcagtgagccaagattgcgccactgtatcactgcactccagcctggatgacaacagtgaaactccatctcaaaaacaaaacaaaaaaaaaccagaatatcaccctaggtgggcatggtggctcacaactctaatctcaacattgtgggaggccgaggagaaaggatcgcttgagcccaggaggttgagaccagcctgggcaacatagcaagacactgtctctacaaaaaaattaaaaaattagctgggtgtggtggtgcacctg

SEQ ID NO: 15817 - DNA, 1162 bp, Homo sapiens
tccatgggatccaggagcctgcagtcaccgatgagcctggaggaccacaaggtggccagggcccttggagagctgtgctgcggaatcgtaaagctaccatccggagctggccgtcccagagggaaggcttggtcatctcttcccctccacctggtcctcagccctggtcccgcagtttgtcatcccgcagtttgtcagcatcgatgtgggactgggagaggaaggatattgccagttatggttgaatgtcattgtcaggggagtaagaagtagtttgtgattgttttacgtggctctgtgttggtatataattatgctgtcatcttaaaacgccctgataccttaatgaaatctgtgtgtgtgtgtgtgtgtgtgtgtgtgtgtgtgtgtgtgtgtgtgcgcgcgcgcgcgcagttagtcttcggggctgcttattgtgtgtgagagccaagtctttctaacacacgagctgagtgcgtcgtcttttacttgtttcaaaactgcccattcgaaacaggtcgcaatccattataaatgcagctgccagattaatcttcccgaaccattgatttcatcatgccattcctctccttaaacatccatggtggcccacttaggcacagagtggagaccacatttcttagggtagcagacagagttcctgatagtcctttctgccccacctaaaccttttccatcccagctagaatgactccagaatcttgcttatttgggggagctccctcctcctccctctgtacatctgagcttcaagcctacttcagaatttttttgtttttttttgtttttgattttttgaggcagggtcttgctctgttgccggctggagtgcagtggtgagatcatagttcactgaagccttgacctcccgggctcaagcaatccttccacctcagcctcccgggtagctgggactataggcatgcaccaccacgcctggctgatttttccatttttttttttagagacagggttttgccctgttccccaggctggtcttgagctcctgggctccagtaatcctccctccttggtctcctaaagtactgggattatagaggtgaaccactgcgcccggccttcaagcctatttcatgcattcctttttcttttgcccctgtgtgcccggcagtagtgatgg

SEQ ID NO: 15818 - DNA, 1498 bp, Homo sapiens
agccttcagatttaatgctccaatgaacagagcaaagactggggcattcaacatcagtgagaattaacccccacatgaccacagcagtgccctctgattttcctaaagagggttgggaaaaaataaaaattatgtagtgttggccgggtaaggtggctcacacctgtaactccatcactttgggaggctgagatgggtggatcacctgaggtcaggagttcgagaccagtctggccaacatagcaaaaccccatctctactaaaaacacaaaaattagctgggcgtggtgacgggagcttgtaatcccagctacttgggaggctgaggcaggagaatcgcttgaacccaggaggcagaggttgcagtgagctgaaatcacgccactgcactccagcctgggcaacagagcaagactccatcttataaaaaaaattatgtagtgttgagaatccttgctatccaaatagcctgaagcacaaaagcacagcttattcttgaaattttatggaatagcctatattttgacctttttgcttcttctaagttggacgatgtgtgcttcgaagcatttctgtgatcttcccacccttaaaaaaaaaatctctgcaggctgggagtggtggctcacgcctgtaatcccagcactttgggagactgtggtgggcagattgcctgaggtcaggagttcaagaccggcctggccaacatgatgaaaccctgtctctactgaaaatacgaaaattagccgggcgtggtggtacacgcctgtagtcccagctactcagaaagctgagtcagcgagatcatgccactgcatttcagcctggtcaacagagtgagactccatctcaaaaaaaaaaaaaaaaaactctccagtttgtaggatttaatgaatatatagatgaccggctgttctgcggtttccgtggaaagcccaaatgtaattagaaatccaatttccgatcgatttttccaatggaaaaaggaccagttgtgttaagtggctaattctttttttatgcagatggttgattgtcattttcttatagtagctttctgaatttttgcagacgtcaaaactaagaaaaagttgtatataaaaattgctcaattggccaggtgcagtggctcacgcctctaatcctaacattttgggaggccgaggcaggagggtcgtttgaggccaggaattcaagaccagcctgggcaaaacagcaagacataatttctgtttaaaaaaaaaaaaaaaagtttgaacataaaaactgctcaaatttaagtacattaaagaaggacagagtctttagtaaatggtagaataacaagccaactatgtagaagccagtagaatcagagctgagccccatgcaaaataaaatctatttagttatttttatttattttttattttatttatttattttttttttttgagacagggtcttgctgtctcacccaggctgaagtgcagtggcgtgatcttggctcactgcaacc

SEQ ID NO: 15819 - DNA, 1293 bp, Homo sapiens
ctacccctactcccggtatccactacctcctagccccaccccatcacatggtacacaccccccttccccaacacacacactcggcctcagcaaagcttcccgtgtcccccaggttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagccaccctggtgccctgtgctctgggacgctggagggactggaggctggtggggatgcctgcggtgccacccctgggagctggggctggcctcacagctgggcacacagaacattcctccccctcttctcatctccaggaattccatgagtacattcagagctctgctgaaacccagatccagtgtccgagtgcttttgagaggacaagtagcaccatcaaaaagggaaacccattcctttattcaa

SEQ ID NO: 15820 - DNA, 1155 bp, Homo sapiens
gccatggcccaaggcctgacggagaagctgcgatagtaccctccccgcgctgggactaggggccgggcgcgtgcgggcgttgtcccggcaaccagggggcggggctgggcgtggcaccgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgggaccccggggtttccggcaggtgggcggggactgggcaggggggctccccaggccggggtggtggcttgcgtgtgctcggggtaaaatgaggagccgagctagagggagaggcagtacttgtgtgagtgcagggtgctgcgccgcccccgccgcccctttgctgactatactggtatgaaaacttgccctggctttcctgcctgagctccgcgtcacagcggaggattagatttcttaaaaacctgttgatggcctctcattttaaagcttgctccgggcctttgtgtaactaaagggattctcccgattgtggaagggctgttgaggggcccagagccataggtcaatctctgcttgcaggtgccctggaagaagggacgtcagagggtcagttgtgcgggcgctcggcccggcctcagacgggaggtacctgggagtcacagtggtccaagacctcgcagcctggtgtgtgttttggaaatgggaacagttgtctgcgcgaga

SEQ ID NO: 15821 - DNA, 1169 bp, Homo sapiens
atatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaacacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacggttttttcaaatctacctccctatttaatgaaagcatatt

SEQ ID NO: 15822 - DNA, 1219 bp, Homo sapiens
ctcgaactcctgacctcaaatgatccacctgcctcggcctcccaaaatgctgggattacaggcatgagtcaccatgcctggcccctgttaaactttctacctagcaatgtggttagtcttcccatcccactgtatagcagtttcaggatgatgctgcctctctaacttggagtgctgaacaggaagtaagagttggctttacggtaggcagctgccaggctagcataaattctggcataccagaaaatccctttgatccttcctaaatgcttgtcttactttgtgccaaatgactaatgatttaaagcagtggttctcaaccctgcctgtatatcagaaacacccacagaacttttaaaaattatctagagaaactgccccacctgacattttgattcagtagcctctggtgtagtttaaaaagctccacaggggagctctttcctttcgctgctgtggctgcagccttgagtatgctcaggcttcagaagaggcttgcctctagtgtcctctgctgtggcaagaagaatatctggttagaccccaatgagaccaatgaaatcaccaatgccaactcccgtcagcagatccggaagctgatcaaagatgggctgatcatccgcaagcctgtgatggtccattcccccgcttgatgccggaaaaacaccttggcctgccggaagggcaggcatatgggcataggtaagcggaagggtacagccaatgcccgaatgccagagaaggtcacgtggatgaggagaatgaggattctgcaccggctgctcagaagataccgtgaatctaagaagattgatcgccgcatgtatcacagcctgtacctgaaggtgaagaggaatgtgttaaaaaacaagcagattctcatggaacacatccacaagctgaaggcagacaaggcccgcaagaagctcctggctgatcaggctgaggcccgcagatctaagaccaaggaagcacacaagagctatgaagagcacctccaggccaagaaggaggagatcatcaagactttgtccaaggaggaagagaccaagaaataaaagctgcccctttgtgtgtacatactggcctccgtgattacatagatcagccattaaagtaaaataagcctttatctgcttgcaaaaaaaaaaaaaaaaaaaaaaaaacaactccacaggtaattctgatgtacatttgaggtttcagggcttgtacccat

SEQ ID NO: 15823 - DNA, 1168 bp, Homo sapiens
ttctggccgaaaagccagtcatttgcattttgaacatcgacccatcttcctatcctctctctctttttttttttaaccatttccaaaccctgttgcttttcttgaacaatgaaaacccgagtgtcagttttgtcttgtgtgtaggtagttttacatagtttccctctctttttttttttcctgcttgttttctccataatgaatataaaacatttctaggagaggtagtgaaataaagtcaatttctctctgggtaatgataataattgctcatcttccctgagggaagggcatgtttataaacacgttgctggctttaggacagtggctggtgacagatgtttctaggccaggcagagatctcagtggaaccaaaattcaagaagaaagattcttttatagagacagcctatttaaaatagatttggttttaaaagcaacatttaatatcagattagtaatgtgttttgctttgtctcttccacttcctacccccaaccagtcattatattttggagagaacagattaagaagtacacaggctgctacccaagttgttctgaatgttcctgaaacaagagtaacatgtttagaaagtggactcagagtagcttcggaagactctgggctctcaacatgcacagtaagtgactcaggcaaccttctctaagtgacccttcatttagcgtagcaaattgttgattttaatctttagctttttcgttggctggtggttcaaaaagggtgacagttattttgccttgacagatttccatgagttgtgaaccttttcttccagtggtacttagttacagggtgcatatgtatcctgttgcattgtctgcatcttgttcttgtagcttattattgattatttattttcagtagtattgataataatgaaagaaatatgtttgcagggctactctgccaagtgtttttactgatgtcttatttgataaaaagcaattgtttgtagtgggcatcctcacacctgttttatagttaaggaagtgagagaagttaaatggttttgttcaggtaactcagctaatacatgacagagccaggatttcaaccgaagttttctgacagtctctgatgttcttgatactacagttattaattggctggattaatgagttgggcaaagaatcctcattgaagg

SEQ ID NO: 15824 - DNA, 1099 bp, Homo sapiens
tgtagaagatggcatcatcattcttaggtcattaactcatgaaatacaacattttccaactactactgtttttccacgttttttaggatgcgactctgtacaagtgtcacagaaagtgaggttgcacgagccagaaatcttctgaaaacaaacatgttgttgcagcttgatggtaaaaataaagatataggttctgttttcatatggttgatctgtattccaatagttaatttttccttctctttaaacaggttcaactccaatttgtgaagatattggtaggcaaatgttatgctataatagaaggattcccatccctgagcttgaagcaagaattgatgtaagtagtcctgagttactattgggtcatgtgtaaaaagatccttgttacaaaagctgagaatatgtatctttcatcttgctttagttttaaaaagttccaggtatagactttgtttttactacaaacagctgaatgacagtgtcttccatatttcaggctgtgaatgctgagacaattcgagaagtatgtaccaaatacatttataataggagtccagctattgctgctgttggtaagcctggcttcttttcttctatgcaaaaagttggccaagtacttttaattaactcttctttttaatccttaggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggag

SEQ ID NO: 15825 - DNA, 1197 bp, Homo sapiens
ttacttttttttagaaaggcaaacttcgtgcatggcaaaaaaaaaaaaaaattaaaatattgtgttcctaataacattttaaagaattaatgtcagtcctatcagggtgcatttgatagcactataggatttttagcattagtcatgaattattttgcatgtgctttccagaatcatacaaagctgagcaatctaggggtgagaatgctaacatattatctgtttttgtttttaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatccaagcttgtgtgtatttatcttttcacttgcttttctcaaaaggcaaggtagtttgatcagaaacagaccaactttccctctttcagcctacttgataactgtggtatgcttgtataaggtttatctggtcactttcttaaaattagctacccaacccagttttttttttttttatcagtatcatggttttattttctttctttctcttttttaaaatcactggcctttaagagttccacaataattttttttcctgttatatcacttgtgaactttggttttgattttcttgtccatatttttgaagaaattttcttttagcatttgaatgcttgaaaattattttaagcagacttaaagttcttagttatagaacctagtgtaaatttcagtggcattttatttcttcat

SEQ ID NO: 15826 - DNA, 1153 bp, Homo sapiens
ccgtatagatccgtccttgctgggctctgtcttaagaacgatacaatttaaagtcaaagaggaatcgctagagttagctctagagtaaacctcgttttgcctattttgttccctttttagagatgtgaataaggtaaggtgtttggagttctggagaccttggagagaattaagtgaggtgcattcaactcgaggctggagacatgaatacctatttggaaaatagtctgtttttttccttcaatttctgagatggggagtaaaaactgaaatttccctcttttgtcctttacagattctaaaaatggcggccccaggctgatgttgtggtaatctaatcagctcgggtcctccacaccccatgcagtgcgtttgtctgcagcatattacaggcttattatgtttacatgaaaagactgggctgtttttccttccccgagccagttacaaaaatgtgttgattttttactgcaaattacagtgctgtgttttagctgattaatttgattcgtttttcctgaaaggcaaataaaatgtctccacttttgaaaaaaaaaaacagccttgcaaatttcagtggtgatgatgggtgcgcttcaacattaaaaaaaaattatttgggtaccaataatagtttttgtttggtttaatccaaccatcttttattcaatatgccaaagtagattaaaatgtttagtaactgtataagtatcatctattttatatgattaaatgtttcaatctagagtaagacatttcccaaccacctcttgacccattttgtggattttggtttttgtattgtgttttagcttaaattttagggagctgtacaaacaagcttaaacctgttacttcattgggtgtagagatgccattatattttgccatccatttttcccatgtatttaagctttccttaagaattttcaaagtttattgtgtatttggtaaagtgaagcttcatgctgcctttaacaatcgtcttacagcatactatcatcattatgtaagttaaaagtaaggctccgattctggatttttttcctcttcaaatatgcccatttacctattataggattgtggaatttagtctgttttaatagaccttaaataaaaacattaccataatagggtcttgaatccattttat

SEQ ID NO: 15827 - DNA, 1604 bp, Homo sapiens
caagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttacccccacccccaccccctcctggtcctgcccctcatcaccatccaccaccccatccatccacaggactccaaggtctacaagcacaacaccagcatgttgtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagttttaccagattgtcctgtacaacttctaagatcgggatct

SEQ ID NO: 15828 - DNA, 1290 bp, Homo sapiens
ctgtctgcagctgccttcattttctgactgttttctttcttgccttgcagaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttcc

SEQ ID NO: 15829 - DNA, 1103 bp, Homo sapiens
gactacaggcacgtgtcaccatgcttggtaattgaaaacattttttgtaaagacgagttctcactatattacccaggctggtctcaaactcatgggcgcaagcagtcctcctgcgtcagcctcccaagtgctgggattacaggtgtgagccacctcacccagcgttgcatcagatttttttttttttttttttttttgagatggagtttcactcttgttgccctggctggagtgcaatggcgcgatttcagctcactgcaacccccacctcccgggttcaagtgattctcctgcctcagcctcccaagtagctaggattacaggtgctcgccaccatgccgggctaatttttttatttttagtggagatggggtttcaccatgtaggccaggctggtctcaaactcttgacctcaggcgctccacccacctcggcctcccgaagtgctgggattacaggcatgagccatcgcacctggctttgcatcagattttttttaaaggaaataaaacattacagataaagccttttccttactgaggtaaagttacatttttcctacctttcactattaaaaatagcacacaaatattcttctgcagtgtgtgaaggcttctctaagacctatcactagaaatgggaactattggaatgtgagatgttcatgttttccattgtaacctaggtattccaaattgttcagcaaaatgtctgtaacaagttagtctcccaccagcaataagtaagatttcctcttgctccatattgccaataacttgatgtttttggactattgccaatctgataagtttgaaattgtgtctttgatgctttaaaatttatgttactctgattgctatttaggttggtggtcctttcctgtatttattggccatttggtttccaccaccctgtactgcctattcatatcctttgcaaatttttctgtttggtgctttttcctgctgaattgacgtgctctttatgtattcttggtattaacctcttgacatttatagaggttgcaaatatcttctctctgttcctggcttgcattttcactttgtgatttttgtcatataaaagttctttatggccggggt

SEQ ID NO: 15830 - DNA, 1230 bp, Homo sapiens
ttatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 15831 - DNA, 1269 bp, Homo sapiens
atgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcc

SEQ ID NO: 15832 - DNA, 1559 bp, Homo sapiens
tttactattagaaaatactgctttcttaaaggtgattttaaaaagctagctgatatctgatggctcaagcatccagaaaatgtatgcaatgataagacattgactaggatgaacagaaaagggatacaggaaaagtccgaacacatgaaattctaaattaaccaagaactgccaaaattcagttcagccaccctctcatctgactactgactgaccactatttttaaagaaattgtgaaaaatttaaacagatatgacctgcattttactaagaaacaggcacatgtacacaatgaatttaaaacatctttggccagccctcctactataaaaatattgatatcttcccttcatctttcaatgatacttcaaattgaccccactatatcacatgtaatttttttgcaattaatctaaaaacgctgaacctaaaagatgctagtttagtaatggaaaagttataagaaacaagtctatccaagatagcttatcatatagacttgtttgccaccattcctgggcctatttcttctcctccttgaaatttttcaatctagaaattctgtgccaatggcacaagtccccatgaatgacagctaacataccccaacacctccagccttattggtccctcaccaattaaggaaaaaaagctgttgagacaatcccaaaattattagagaaattttctactgtgatattaatggattaataatgcttatctttcaacccaactagaaacactgcattccaaaattatttttccaactcaatgtttagaacaaacattcttttgaagtttgcctgagatttcgacttgccatgctatgagagtaaatgacccttgaggaaaggcagtctttatatgatgatgtgataacattattaggttttgaagtataaaaatgctagagacagcatcaacacaacctcttaaaggttgtaacaactgctccaacatgccagtacacctgcacggataaggcaagataattttaaacactatttattgaaacatactgaattggttcttttcctcttccaacagtcaggatttaaacgtttctgttcttcagccaaagcctttgcttctaatgtgtacattcttctctcttcattcttcattttcttccacctgtcaccaaggatcacacttatggctctgtaaaataaatatttacacaatgctgaaagcacacatttttcataaatctcatgtcaagtgctgctacttcaggagaaaaatgtgaagttaaaaaagatgaaaatcttgtctatcacagagatgggaaaaggtcaaggccataatgctcatttccagtaaaatcccgaatcaaataatccattgttccgtatcagcagcatgaagtattcaacttgtactaaaagctaatctatttgtgcccgtaacctatcaaatagttttgataaaggtcttttctcattcaatcatagtggaagtgtagaattaactatgcatatcttactatttctctctcaagagaaaaccaaataaacctttagacagtattttttattacttgagaaaactggataaa

SEQ ID NO: 15833 - DNA, 2011 bp, Homo sapiens
tggggtcaatttgaagtatcattgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgt

SEQ ID NO: 15834 - DNA, 1131 bp, Homo sapiens
gttaggaatttgccttatgttttccatctcatctcctgaacctgttattctgagaactcataaataaaattcagccaagattaatcaatcaatcaatcaatcagtagacgtcagagataagcaacttttttttccatttatttgaaataatatacaagaatatagtgtgcaaaatttaggggcaacatcatgaagaagtgtgatgaactgaaatcaattttacagctgtgattcctaaccagaaacaccacttggtaagtaacatgaaaagccatgattgtagctcagagcaaaagcagctgtattgccaatgtatttgctctaattttagacagttggaggaaaattaaagtgcaagtgttgcactgcagtaagtgcaaagtctgcccccaccataaagattatgatgacaaaatatatttaagatacatggctgaggagatacagaacacgaagttaaaaaatacaatggtgttgactgtttgttaatagcaccattacagtgactatatcccaatgctattaactaactttaccttggcctgggctaggtctccattggaaataataacggatggctgctgccacctggtgcatcaactcagcatgccatggtaactgcagcaggtggctcttaggctgggacaccaacaccagccacctgccccatgttctggtagcctcttggcactgaccagactaggagcgcctatgtttggcacagatgctgagccatgtggtggttactagaggaaaggccgactcccagcttctgcttcatttcatcatgtgtacaatacagattaataagcagtaaggagccaatgtataaacagcagttacatattttttaaattcccctttcgtacaatttaaaataaaacatgtatacacttctcctctctttctactgtactttagcaccacaggatatcaattttcaagcctattattacctgatagacatatatgaagtttggaagaaaaataaggcaatttggtttaaaatgttgatagttttagcttaatgctctaatggagaaagcaaatcctcactcatattattaaatcatttcaagactcaatgctatcagtatcttatggtcacacgaattgaggacaaatggtgag

SEQ ID NO: 15835 - DNA, 1215 bp, Homo sapiens
agacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagt

SEQ ID NO: 15836 - DNA, 1130 bp, Homo sapiens
tttttcttgtgatacattttgttaacctgtgtaaaaggattaaatttcaatatggttgtaaaaatgctatttttatgtgaatttaagtgcagccacatactgttttttaaaccatatgttttaccactaatttcccaaagttataataaaatcctgaaagtaaaaatctactagaatttgctgtaaggcagactgttaaatgatagagaattatttcacattttaggcactgaaatgttgaggtttcgaggtatagtaagtatacaatgcacttcacttggatgccttttcatttttaggcagcctcaggagcaccaaaatacattggaattctagtactaagatatatttgttcgtaatgttaaaagacattactaattatttggaaagagatggccaaaataatcaactctacaggcttcaagctggtgggggaatgctgttactcattaatgcttttttactgaatggtcggaatcacatatgcaccacacatactgatcttaagtaacattattttatagaactgtttaaatgggtttaaatggtgttctttagatgaaatgtgttctgttttgttcattgtcttaaactgaatagggctgaataggctttatgtaattcttcatttcatggtagagtttgatgctgtgtttaagtgggttcttgtttataggattttcaactacagtttgaatgccatggaggaatttgaataatatattaatgaaggacatattcttgtaatcacaaatttgcatttgctcaggtttcattgctgtgtgataggatttttcctctaacttgaaatttaaaaacttttatttcctattccttttgtcggtaaagcagtctgaatttggaacattttatcatggagtcaacagtgaagactaccagataattttgtattggagaagaggaaataacagctaaattgtggatttcagtgctttacatggtgcctttcgagtcagcttttacattataggggcttgttatagtttagctaagatgaccacttaacagtttatacagaactcatatgtataaatcaacattcttaggatattatttatatcctttgaataaatccctgtgaagtttttcctccccactaaaatggtgca

SEQ ID NO: 15837 - DNA, 1276 bp, Homo sapiens
ccttggaagcaaatttacttggcttgttattttaaagggtgctggagaaatggtaaatgaagctgctcttgctttggaatatggagcatcctgtgaagatatagctagagtctgtcatgcacatccggtaattattaacaacatatagaattgatggttgcctaaattttcttctgacccacaaatatttggattttaattttaaatttcttcccttgcagaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaacggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattcatttactggttatcatgagtacgtgttgagatggtcatagttttttttatgactacttctagtgtatattctaatttcttttctaggcctgaatgtatctttattttcatgttataggacaatattaaggcattttaaaggtcatcatcctttcatctattttagatacacctactaaatgtttaatatatacttttggagaagtacaacataagggagtctttaatctgtgttttccttggctgggttaatgactgtttatttaaagagtgttgtaaaattgg

SEQ ID NO: 15838 - DNA, 1135 bp, Homo sapiens
tttgacatagcatattgcaaattattgacacccatatctgcacctcattggactgtgtataacatatacaacatatagtccactggctgatactaaggaggtagtcatacctttattgaatgattaaatgaacgaatgaaggaacgagcactcaaacttgccactcatattacagtggacatggtgactaaatatacgaaagtgtgtttgctatttaggcctgtttataatcagcttctaaagagaaacagtttacttatccagtagggtggggaaaagtatacattttagaggttagacattttccttgcaagaagagtctctgtggaacagcttgaattatttgaaatccagccacagtctgaaatacaaaccatatgcagttcaagtttgtggcatgcagttgagtgacatttttacctgagattaaaaaaagtagagactaccaataaaaaacatcaaatgagatttttgctcctgcctttagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtttgtttgcttctgtgttttacattctacttgcaaatctactttttgattattgcagaagtaccaattactcttgtttccatttttaggtgatatttcgtgctttagatcctgctttcaaaatagaagatccttatagcccaaggatacagagtaagttcattttcaaacaaaagtgttttttgttagtttgtttgtttgttttgttttgttttttgagacagagttccgctcttgttgcccaggctggagtgcaatggtgcgatctctgctcattgcaacctccgcctcccgggttcaagtgattctcctgcctcagcctcctaagtagctggaattacaggcatgtgccaccacgcccagctaattttgtatttttagtagagacggggtttctccatgttggtcaggctagtcttgaactcccaacctcgggtgatctgctcacctcagcctccc

SEQ ID NO: 15839 - DNA, 1150 bp, Homo sapiens
cctgttgtcacctgccagcttgaccctggctggccatttgtcctccctgggccctgtcactgcatttatgatgcagtggccctttccctgaactacctaggtgggtgataccttcttccttgtgcaccttttaagcaattatcatatatttctgggatatttccctatagataatgagttaccttatatttacactcatgttatatatgacatgagcctctgcagcttcaactattccttaatccaggaccttttcttggggaggaaggatattttgctagataagcacacttttggagttccttagcagactgtgtgcttctatgggggtagaaactatacccaattcatcctggttttgcccttaacaggttggcaaactttgccttaggaatcatagcatctctgtcataactactcaactatgccattgtagagagtgcagccacagaggaggggtaaataaatgggtgtggctgtgctccaaggaaactttatttacataaacaaaggctgtgtcagattccacctgtgggctgtagtttgctgagccgtggcccaaaactatcaacataatctcaacaaatggttaaattttaaaaaaagattcagtaatatgtagtaaaaatgagcttgcattttcaagaaatgaccatacttggtataagacttcatattaatgtataggcttctaaacaactgaagaacttgggaaggtttggtaaattttccctaggtgtatcattgaaaaaaatatgttgtttttgaaactaccatacttccaattttatatctttcagctttactgagtttgggcttccccattaatgactgtctttttgttacaatcaatggcatctggaaaaatcacatataatcctaactaggtgagaaaaaagtagacatacatgatttccagctgttttttttttttttttgagacagagtttcactcttgtcgcccaggctgcagtgcaatggcatgatcttgggtcactgtaaccttcgcctcctgggttcaagcaattctcttgcctcagcctcccaagtagtggggattacaggtacctgccaccatgcctggctaatatttgtatttttagtagagagggggtttctccatgttggccaggctggtgtagaactcctg

SEQ ID NO: 15840 - DNA, 1228 bp, Homo sapiens
aaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataatctgttgttaaaaggctaatgtcattttaaaattaatttttgttcataatgtagctcccctttagcctttgaatacacctggcagcagtatgcttaaaaataagaagttagttgcctggcgcagtagctcacacctgtaatcccagcactttgggaggccgaggcaggcagatcacctgacgtcaggagtccaagaccagcctggccaacacggtgaaacctcgtctctaataaaaatacaaacattagcccggcatggtggtgcacacctatagtcccagctactcgggaggctaaggcaggagaatggcttgaacctgagagacggaggttgcagtgagccaaatagcgccagtgcactccagcctaggcgacacagcgagactccatctcaaaaaaaaaaaaaaaaaaaagaagaagttaggcttgttttaccttattaac

SEQ ID NO: 15841 - DNA, 1198 bp, Homo sapiens
tgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaaggcaagttgttcagtgtgcttttcggttctattactttttgtcaaatttataagttttatttcctaatgagaactaagaaactttcattgttctttagagcagttttgtattctaatcatatctatttaatatgtctttgtagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggtaatttctaatttatttaatctagttttgtcttggaatagaagtactaaaaaaaatctaaaatggagaaggcaaagcctttcatttttccatttgaattttgtggtttttattatacatgtgatgtgtattcagtaattaccctat

SEQ ID NO: 15842 - DNA, 1120 bp, Homo sapiens
gacttttcagtattgtgctgatactttacagttgttttctttattcatcacaaccctctaactaggttttattacctatatttcacagatggaagaactaagctcctagagattgatacaatttctcccaagtttcagaagggggaagtgagagagttataatttaaatatggtgaatttggcttcaaaatctgtaagattctttactgtattgctcccagtggacatcaatttctatggattaaaaccacttgattgcattagaaaaggttttcgtgaaaggacagtatgggattatccagtgagtgcttattgaatgcctattatatacttcattttggagcacaatcattttactttactagcactattccagtggaataaattttgaaatttgagactgtgcctcctcaaaattgaaacctttgaccaaggagaggagagttccctcacagtcctcttcagccagcctgtttcttagatttctttggtaaagatcagaccagtctgtccactgtgctctcagatggcatctcccagtagctcttttcatttctcacacttccctatgggggcggtgggactcacggaacagcagttaatttcccctaaatatttactgtcttcagtccctttatggcctcagtgtgggtgctgaactgcaaaacttttgactgcgtcctttgcaaatcctgcaaaaatggtcttgcattttgcctttgctttggaatttgttttggaagtatttgacaaatagttttttgttcttaaccagtatttcagatgaactaggacaaagagagccaatttaatattctgttgctacgtacacttttaagaaaaaagaaaattttctaagtatgtagaatttaaggggtggatcaaagggaatagacattctgaagtaatgacaacttcctacaaagggtgatcaattatctggaagtttaaagaaactaaaaggtcacttagctataggctgaagttttaatatcccttaatactttttagaagtatcataaaaatcggccgggcgcggtggctcacgcctgtaatcccagcactttgggaggccgagacgggtggatcacgaggtcaggagatcgagaccatcctggat

SEQ ID NO: 15843 - DNA, 1160 bp, Homo sapiens
agattgtattctactactggattagcctttcagtaaatgtgtttcaaaatggtctcattagccttttaataaatattataattaaatatgcataaatatgggaaggtctactgtgtaacaacatggttattatatgtttcaaattatcttgtattcttatggaattgtatacctgtttctcatgcagaataactacacccttaagagagtatactaacctgtttttatgtttgtaaagactgcaagtcagctaggtggcttgaattaatctgaattcaccttcatgatagagctgaagaaattgatactgcaacttatcatgtaacaagaagatctcaagtttaataagtctttgagctgattcagacaatggatttgttgctaacagcttttttgttaatactgatgtgagaatgcaattggatattataaacactcttcagttcaactgtttagtcattaaaataattttgatataacagatattgattaagaaagggattttagagatagaaagacttgacttcagttctctgatttgccagttacaactacagcggtgcccttgggtgattataacaatacctgcttcatagaattgctttgaaaaataatttagataataagatttagtaagtactaataaatgtgaagtattattataaaagtcatgaacatttttgtcttaaatatatttaaatttgctggaagttttatcaatttttatatttgtgacaattataaaatgttgactaactggattataagtatgctaagctataaactttttgggtggtcctttgagtgccaatacaatccacatatcagaaaacattatacagttgacatttaataaaattgaattgaattttcatggcttcaactggtataagatgattatcatgcaattttgcttacatcctgacatataattgttttataatttttctatattacctgccaaactacattgtaaacaaaaattgattagagattatatttcagttttttttatattatctaaagttgtgttaaaaaacacgatcttcagctaccaagtctattccataaatatttcttggattttaacatgattttttttaatggattctccgtattccccttgattttaaaagaaaaatgaataagtaaaactaagt

SEQ ID NO: 15844 - DNA, 1166 bp, Homo sapiens
aaataaataaagttaataaatgtattttttacggttttaaagagttatttttaatcccgtatttatttttaaaaatgttggtagggaaaccctgaaggtttacctaatggactgtgtacatccgaaatgcttaggagattaattcaagggcaatttgagcactgtttatatgagtacattaaggagtttgaagatagaaattggcttgaaacacatttagttgaactgttaaaataatcccttaagatagatactaatctccattttacagatgaggaattctatttagagaataagagtaactaatcgatgatcatttggctaataagtgggatctaggatttgagtgaggtctgtttctatagtttgagctctttagcctaagtttgtaacttacatcaaagcctggagcatggggtttcaaaaatggtaaatgctattttgtcattgatcaaatttgggaaataactgtcttagtaagttagtctactgaaaagactatcgtgattgcatcttggctgcttttataggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaactgtaagtataagatatttacatttatagatctgtctattcatgacacccagacgtggtgcgcctatagtactgtaccagctactcaagaggctgaggcaagagagaggatcttgtaagtccaggagtttgaggcagcggtgagctataatcatgccactgaactgtagcctgggagacaaagctacacactgtattttaacaacaacaacaaaaaagataattctatatttatggatttgggtagacataggaaactgaaattctgatttgtgaaagtcttctaattttggggtttgagaaagctttcattctctaattgttggatgtttacctcttgcaacacttgactttagattttgggttttgggggttttattttttgtttttggtgcggtaataagtgatacaagtgatcatatggagatgttttactgtgtcacagaaaacagaagacactgaggtggtcttagtggatttg

SEQ ID NO: 15845 - DNA, 1986 bp, Homo sapiens
gatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaattttgttaaaaattaattttttatttaatgatgtgcaaatattgaatattttagtatatttattaaaagtggtagtcattaaaaatgcccatgttttagagttcatgtttggaagtttccattataggttaaggatttatattagtattgtccaaataaaatagtata

SEQ ID NO: 15846 - DNA, 1105 bp, Homo sapiens
aaagtctatgtactaaagtggaaataatcttgaagttcttaatatgccttgttttctgtttctgcagagtgtctataaatgtgatttcctgaacttacagcttcagcaaccactccagcttgcacaggatgctatagatgcttttttgaagcagctgaaaaaccctattgattctcttcctggagagcttttccatgtggttgttttctctctccttctttcttattttccatctccttaccagcgatggatttgctgcaagaaagcccatgaactgttagtgttaaatggtttattactaatcatcacacctgattcctcccatcagaaccgtcatgctatgatgatgaaaagctggaagattgctatagagtccctgggctttaaacgcttcaagtactcaaaattttcacatatgcatctgatggcatttaggaaaatctctctaaaaaccacaagtgacttggttagtaggaactacccaggaatgttatatattcctcaagatttcaacagtatagaagatgaggaatattctaacccttcctgctatgttcgatcagatatagaagatgaacaactagcatatggtttcacagaactccctgatgcgccatatgactcagattctggagaaagtcaagccagctctattcctttctatgagctagaagaccccatattacttttaagttaatatagaagcaaaaagcccctttcagtccaggctcctaaactaattgcttacaccaattggaaatactaacatgaactcagtactgaaaacctggtttgcataaaagaaatgcagaggtttacagagtttgctatttttttctacttctcaattttaaaatttattcttatatagaaagcttaaagtttcatgcagagtgactcatgtcatagcagaaactactgttactttagcatttagcactatcatagaaaggtacctttttctctttagtgctattgtgaaaacaagcataatttgctatatgttttccttttcaacttttcagtgttgactataaaccattgaatggaaaactttaagatgtagaaagctgtagattgcactttgatgactcacaagttaaat

SEQ ID NO: 15847 - DNA, 1773 bp, Homo sapiens
ctactaaaatacaaaaagttagctgggcttggcggtgtgcgcctgtagtcccagctactcaggaggctgaggcaggagaattgcttgaacccgagaggcggaagttgcagtgagccgagattgtgccactgaactccaacctgcactccagcctgggcaacagagcgagactccatctctaaataaataaataaataaataaataaataaataaataaataaacaaaccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattcatttgttacataaaatataaggaaatctttatactattttacagtaaccacaatctaaatatttacatatacccaaaattaacttatgctcatatattaggat

SEQ ID NO: 15848 - DNA, 1149 bp, Homo sapiens
tgcacatagcacaattgttctggtccacactgaaaaacaggtaacattatatatttttttaaaaaactgagctctttttgaaaatgtttctgatagaagatggagatgcagcctgcaaaagttaaaaaaaaaaaaagcagctgaatgaaagatattctcataaaggaaaaagtgaagtatgttagaaaactttagccatgatattgggaacacggtacttggcaagagaagccagaagtgaatgaatgaatggtatttgctagatagaagaaagtgccaagttaaatgaatctagaatacttcaaaaatgtccctgttggagggatagtgtgctagatataagggacagtcggcatttgctaaaacacgtgagtgacatgtcccagagaatgaaggaaagtgcagggcatagtggcagctggcgtagagactatggacagcaggttttttacagagcaatgttgttcatggttagtggtgatctgtggaaaatgtaagtgaacagttttgacagagcagcatgtgaaagggaataaactaactagaatatctggctgccatgcaactgactaagagaaagctatatgggtacaaaatcaagatgtaatatatttgaaaaccaggcagtaagtctgagaaaggaaaagaagaaatatattctgagccagaattgagaggcatagcattttcattcaatacatttaactggcatttgtatgacaatcatttatatcagaaaaaaaagtacaatgtttgcatacttcaaaaacatcatgttgtacaaagtaaatacaaacaattgtatctgtcaacgtaaaataataataataaaacagtaacaactgaaaatgtattgtagaatactaatgaataagttacaagaagttatagtgtgcaaaaatttaccatttgcttatttcactgtttaacaacttttcttcccttggtatggacattcttaagtaaagagcatttgccgaatgagcaccatacacagaacatgtttaaaggacttatggagagagagaaataaagtggaggtgattctgataatgagaaataagattctggtttaaataaaatgtataaacaaatagcacagaccactgaaaatgaatataggtgttggggtctaacataaatatatct

SEQ ID NO: 15849 - DNA, 1150 bp, Homo sapiens
tgatattgagcatgttttcatatattttttggccatatgtatatcttcttttgagaaatatctgttcatgtcctttgcccattttttaatggggttgtcttttgcttgttgaattgttccttatagattctgaatattagacctttgtcagttgcaggatttgcaaatattttcttccattctataggttgtctgtttgtcctgttgccagtttcttttgctttgtagaagctcttcagtttaattgggtccctctttcaatttttacaacctagcttttaaaagccttatcaagcaaagtcgtgttttgtttccttcttgcttaaatatatggatacttattctccctcctaaaaaaggacttgcctttgcataccatgatatagaataggcctaaaagtattttatgaactataaatgtatgaacataaatatcaattaggtacaattaatcattttctacttattttcaaaattatagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggtaaatgatatggaacagagagtttctttattgaagttcctggagtatttatttggggcagtttctttgatgacctaatcaacttcacacatcccagatctgttattcttccggggttctcattactttgacttctgattcctgttctagtcttttgaatgtaagactagatacttcataaaatttttccaactccctagatatgtttacctttttgagggaatggtctaacgttcttaataattagatggaaatcagatgttttatatcaatctagtaactcttctagcttagtcttgagaggatttatcttaagatggtaaagaagagaatttttgtcatagtttagaactgaaaaaaatattcaacattatctttgtgtttttttcatttcctttattaatactatataagac

SEQ ID NO: 15850 - DNA, 1211 bp, Homo sapiens
gtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaataatcattgtatctttttattcatatccttttttgagtgaaaaatgcttctgcaactaagcatgtgttacagcagggggcgatgtctccaaggataaaaattacccaaacgaaaataaaagtctgcctctgacaggacagcacagaatctagatgtttcattatggagaaaagataaggtttatgaaactttcaaatcaggacttttaagtttggtcatgcaagagtttttttctttttcaaagaaagggaaagtaattttaattaaaatttgggagagcttattttctattcagttggatctaacaagccttttatacttgggtttcaactctggtttctttatatgtaaaaaatattaaaagaagaattttttcatggaaacttatcgtgagacagaaagcaaatgg

SEQ ID NO: 15851 - DNA, 2193 bp, Homo sapiens
tttggtagagacagggtttcactgtgttagccaggatggtctcgatctcctgacctcgtgatccgcccacctcagcctcccaaagtgctgggattacaggcgtgagccaccgcgcccggctcttctagctgctgttaaacagcttttaaaacaatgttgggattttatttgactgtttaaaaacagtgaaacaggctgcttaaataaaacttattctgaaaacatctatgtgctttataaattgttctgttctttgctttactttaaacttctaactattgtttttcatagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttattttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgacattttgtctaaatcatcttttctttagttttaaaatacaagttttggcacattgggattcctaaagaaaatgaattggtaacattaattatctgttcctttttaaaatatatatatttgaaagtttgatgatggtgaactaaatactagatctaattgacaagcttagttgtatcagttaggccatcatgagtttctatcccatgaaagtcatcaatttcctatctctgttctagtctggaatgcattactgaaaatgtatgcaactgtttttaaggtgatttgcttgtgagacggaagatttatcaaaaataatttagaacaggctgggcgcggtggctcacatctgtaatcccagcactttgggag

SEQ ID NO: 15852 - DNA, 1149 bp, Homo sapiens
tcttgagttttgtgacttaaatatgcagttcactgactcacgccaatgttgtttgctttttaccttaattctttttactgtgctctctcagttttattttttggaagaatggtactcagtgctttgatttgattagtaagatttttgaaacacatgtaatttatttcagaaatgtgattgttttaactctgacttttttagtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattgaaaaaaaaacctttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagtttgtattgaagtagtgctagctattattgtcagcaattttcca

SEQ ID NO: 15853 - DNA, 1219 bp, Homo sapiens
tcttcacataaatgtttacaagcattatgattcactctcatgccttagagtaatagatgtatagaatataggaacttctttgtagactgaggatctttcatcattctaaataatagcttttatcgtatgacagtgtggatgatggccttataagcaggaggagattaggctctaagtaatcacagggcatattatgaaaagtgaccagcctccaccatcccctcctcccattctctaatccctaatcagttttgctttaattttcatgtcctgacttctgaaaatggagtatagaacatttcctaacaagttgagagtctgggtcttagaacttaaaatttattgaaggagacttgggagattatttagcctaacaccctcattttatagattaaaaacctctgaggcatagattaattgacttgctcaaggatactaagcagattcactaaaagaaacaaaaatttaggtttcctcattaagctgacactttaacagtgtcccaaattttggtggttatctttgatcttctttgaaacaggtagatcgacacttgagaaagctggatcaggaactggctaagtttaaaatggagctggaagctgataatgctggaattacagaaatattagagaggcgtaagtaaaatttacagttttccatcaatattggacagtacatgtgcaaatcgctgagaagaccttgtcccacagaggcttttgaaatcctgcccttcaatggatggtggcatccaggccagatagcttggaccctaacagttggaaatgtttgggtcatgcatactgagagagataatataggatatcatccactcactctttatgaaacaacatattaaatcattttatatccacatatactagtaagttgagtggtaagaacaaatttaaagaaatgtaaccatcgggagacaaattaaccatcttgcattaagtgtgttgactttactctgcctctttatacacttaagctttgaggaaagttgttagtttctcttcttaagaattactttatggcttttccttaactgcatatactgaaaaagactcacattggtttcataacactacctctttttcttaaagaagtgttttcttctttcccttagcagcaagaaaccattttgatatttctttgcaaggctctatttgatctcctgctataacttacccctgtcacttctttggtgtgacttccc

SEQ ID NO: 15854 - DNA, 2126 bp, Homo sapiens
ttaaatgaacttattgttgacatgagtattactgaaatgagaagtgtgtaaaatgttacggcaaatcagcagtttacaacggttttttaaactgtatattattactgtgttccaatagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtgaatttttttttttttttgtattatctggcaaagtaatatacctacagaacttcacaaaaactcacacaaggtttttcaagcatttattatactgcctaacttggaaaaaaaattgttgctgtggttaaaaatagtaatatcctagatgtgtcttaacatgtaagaagctaagtatctagatggcggaaaaagcccttttattaagactgtaaaaggatagcttttccagatatataaaatgttaaaagaagacaaagattggttatgttaactggtgtggtttccttttgtctcagttcaatcttgtata

SEQ ID NO: 15855 - DNA, 1178 bp, Homo sapiens
caattattcatgatggatattttgtgttttttagctccgttattataagtacagaaattggtgtgagaaggagttaagagtgtacatgggcaaggtagtcaatggaacattaggccttttttaattatcctggaggtgacgattttttgtgcatatatggactagaagtgcaaagtaacattcagaaccccccacatcctaaaatttaaaaataaactcatagttagataaaatatatttgccctaatgcagatcatattacttgactcatttgcatccattattagtttgtttcctaggaagatctggtgtctgttgtgggtttctttgttgctgtttttttttaaaaaaattttttgaggttctttgaaaccctcaggggaacaaattagcttgtattttaagatacgtgtatcttgatgtttttcttaatgctctttgtggtttgagatttgaagtaaagtgaggtaaagtctgttaacttgttttctaaaaaaagacatcatgttttctcccccaaagctacaaagcctcccagatataagtgtgggatctcaaaagcttgccctgagaagcattttgcttttaaaatggcaagtggagcagccaacgtggtgggacccaaaatctgcctggaagataatgtgtaagtctttgttgacttgagacgataaggtgtgctattaaattgcagccaattgaacctgagtttaatggatattttgaaaatgtgttcggtatactttattaatggaaagtgatttccatttttgttatgtagtttttttctcatgaattcaagggaccttaaagttcttaaattttatattagagagtgactaagaacgtaacacttattcggctttatagagataagagatttcctctgagtaaattctctagatctgcactgtcccatttgctagcaacagaacacatgtggctatttaattttgatccttaaatattaggaagaaagttaattcacttaaattaactaaaaagttcagttccttggtatctgtcaccgcagttcaggtgttcagtggccacatgtggttcatggtcaccaaatggaacagcagagagagcattttcatcgtggcagaaatcctatttgcaacattgccctggacaatgaatgtgttctctttattttaaatgaaatccaacgtctt

SEQ ID NO: 15856 - DNA, 2524 bp, Homo sapiens
tgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaataatgtgtttcatgtgtttattgttaagagagtaaaataggttt

SEQ ID NO: 15857 - DNA, 1186 bp, Homo sapiens
tttatgtagtaacatttttcatgctgttttatcaattgagttacgagaatttgagttgcctttgctagtctaaaacattcagactaaaaatatgaaatatcatttttattatttaggacacctaagtgcttatatattttatattaagggcatttgaagcaaaagtagcccttcagattatatatgttccttaacatttttgtgtatcatgatgagaatttaaaggaaattttagtttaatagtagtctttatctttgtagaatactgaaaagtagataatgctcttataaaaataaactggtaatatgatatattctgagatagaggttcataatatatcttaaaatattagagggctacagcaggctaattacttcagattaaaatgttgttttttccttaacagaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaa

SEQ ID NO: 15858 - DNA, 1234 bp, Homo sapiens
aggactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatctgcctgaggttggcctgagattgtgagtcaacgactttgctatcttttcctcagtgttgaactttcattaagaaataaagtcctagcttcttacagagaggggtccaaatggtgaatgctcatcctgcctggattcaaggaattagctcagagattggcccctagcttttctgcctttgtagggacagcaaaaggggaaaatttgctgcagaaaattccaaaagattgctgtagctctcacagggaagtggtaaagatcagctaaacctgggttggggtgctttctgcccagtgggtcttggcataagtagattaatcctgctcttttaagaaaaggcaacttattcaggcagtctggaaagggggttctcagaaaactcagtttctttattccttcttttctcccaactactgttactggttatagaggtctttggactctaaagaccaatgtttggccactaactggactaatatgtatctttctgtgatttcatcatagaggtctgttttgtgagggtttggggtgcagaaaactttgattaaatcttaatgggaggctgggtgacctggattatctacagtgagcagacttaaatggaacagaagtttatgtgtccaaatgatggaatcattaaacctgagtgacttgacctgtgtggttccttaatagtatctatatatctagacaaaaatagattgtgaatgtaaatggtgaatgaaaaggatggaaataatgttttcatatgtt

SEQ ID NO: 15859 - DNA, 1160 bp, Homo sapiens
aattggatcaaattatttatttattttttaaagtattctgggtctagaatgggctgtgcttagggttgttaagtatgtaaacctagagaaatggaacaatgagaggctatgaagtttgctgaatatggcttgcattaagcattaatgtaaaacattcattttggtttttaaaaaatcagagattaaaagctgagcactggcaagtctttttttggtaaggggccactttttactgtaattaaaattattgtcctcacgataatgtgagttttattgtctacctttgccaagaagtctgagatgatgatatttccagtccctttttaccagtgtgttttaaattagaaggactgatttaagaccttcctgagtttagcttcgtggcatgtgtgttttttggaaggcttagtgtggggcgagagtgcctagcactcacatttaggctgcattactcacctaccttgcctttgctttagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccagtgagtgtgtctgtgcagactgggtggtgatgggctagggatgcatttggggtttgaagaataggggtttgcttctctttctctgtatttaacatccattaagatattggccagttgtggtggctcacgcctgtaatcccaccactttgggaggccaaggcgggtggatcacgaagttaggagattgagaccatcctggccaacatggtgaaaccctgtttctactaaaaatacaaaaattagcctgtcgtggtggcgtgcacctatagtcccagctactcaggaggctgaggcaggagaactgcttgaacccgggaggcggaggttgcagtgagccgagattgcaccactgcactccagtctgggcaacagagcaagactctgtctcaaaaaaaaattatggcaggattattattaatatctgctgatttttgaggcattttctagggagttatcatttgtcttacagaattggacaattttctcacctttaggaaattaatctcaagtgttattgggttcata

SEQ ID NO: 15860 - DNA, 1194 bp, Homo sapiens
ctgaggtaatatctcagtaatttcatgtttctgcctgtgagattaacagctgagcatctcctttcccatgctgagatgacaattctttttgcccttcacttgcctttgatttttctgctctctattggggcatcctattttggttctttctcatctagtgctggtatcttcttcaaatccaacccttgcctctttttctagattcacattgagattttgattttagtttagaagctgtttcaaggaaaatcttcaattacatgtagagacaggatttccagttcttaagctttgtagtgaaccacaaatctttgtcagggcaaaaataaaaaaagattgaccatctttatgaatgatacagattttgtctcattgagaaatcataataaggtctctgggaactgataattatagcatagttttctctgacattgttgcaccatgaaggatgatactgtttttcccacaaatggctattgatctcactttctacctgtgagggtggtgggccttgctcttggacatgtgatgggggccatagaagcaggtttaagcatgttcctttttgctcacaggtgatgcaggttctgaatgctgatgccattgttgtgaagctgaactcaggcgattacaagacgattcacctgtccagcatccgaccaccgaggctggagggggagaacacccaggtgagaatagggaagcagccgcgcctctttgcataaaccaaaaggaagaagttggagaattgattaatatatgacatatataatacatatatgtgggaatgcaaagggacaagtattttaaatctccacagtattattttctaatatttatagcctgactactattgggcaggtctcagtgtcttgtggcccacacccactgctctgccgaatttcacgtgggcactgttggcacttctccccagggggcttgagtgcagtgagggttgggatatgtgagatggtggatgagtttaattaacaagatcttatttttctgtgaataaggagaggagaaggtctgtatctcgtgtacattgtaataggacccgtttctgctggtcattttgatttgatagttctttatgtttttgctctaggaagaaatgaatcttggtatatgtattcactggggtcacctactcattttttgcaggtagtaactctaattagtagttaaactgtt

SEQ ID NO: 15861 - DNA, 1162 bp, Homo sapiens
tcatttcttcagatctgttgctaactaaatgtctagcacatagttgatactcaggtgttagatagtgtctcattgcatcctcactgggggcctttactcattattcatagtttggggatatagggatgggcagaatatgctgacacttggctttctgattctaccactctgcctttcctaggacatgttcctcatcactactgggaacgcgggacttttttcacatgctgttgtcttttgtaaggtgggccacaattaggagaaagccacattcatattcgtatggagctgcctttagcagcatctgcttctccagctggagaggcttgttttagaacgactggcatgcggaagcggtaggtggaggtctgggaggagctgcgtagccagggctccccttccagcctcccgtctcccttaggctctttctggcctgaggcatggtcgccatgggtgggggcactgcccgcccgattctggttggaccccctttcctctacttcataccgcagctgctgtgagcgagtgcactgtgctctgcacaggagaattggcagacagttccatatgctggttttggccattgggacattcaggattattaggccagtttgtactttaagaggagggagacttgacatcgctcaaagcagcttattttatttatttctatttcttataaaggggaaagaagctagcccagcccttagctgttcctttcaacgtagccggctcaacgttttcctcaggaaaacatgcagggttcctcacagctgcttgagccaggctctgtccttccttcgcagattgccccgtggctgcctgcctcttcactctcctaaagctttttggctttaccttccttccctcactcctcccagtcttccctcagaggactgactggttctttcagcctagacactcctgtttgcctgccaagttacccttcttccggaggtgcatagcctcagcactgtcagagttcaggagaacagaagctcctccagtgagaagccagttaataacagcttttggacccattgttgttattattagatatccataaaatctagcaggtagagaaccgtcactggggctctgctggagagatatgtctcaatcctaaaagatacaaattagtcccagagtacctgataccgta

SEQ ID NO: 15862 - DNA, 1164 bp, Homo sapiens
ttatgataagatgcaagagggacacaccccaagtggtgtgggcattcaaaggagaaagaaatcccctttgacttgttctttaccacttggattctagtggtgttcctggtttatctgttgtgaggtagaaaccaaagtacagggcatgcagagactgtttatcactgggcacagttatggaggtaactaacatgttaaccccccacccccattttattcttgcttcaggaatttttgtctctgttttctccttgtaaactcttttgccatccccattgttgtagaagccaatctcctacccagacaaacaaacttaacttttttggtggaaattgatggtgagcctgttacaagggatggaactaaattgtaagagtgtccaaatcccacaaacctgccaggtgttggtcattaggtacatgtttgaatgttttcaatttgaagagattcctctacagtctgtgggaacctcggtgtgcaaggtgttttcccttgaagctttctttgcctcttacctagacattttgtgaaggcttctcctcaggcagcccttgtcattttgctgaatgtcagcaaacatttactgtcactgctctgatgtcagggaggaaggtgatgcttttactttctagcaaaatagcccccaacgttttggtagcactacatttaaaggtcaccaccctctctctccttctcttccctcctctgtcctcattgtcatctttataacctgtcccttctgaaagttgtttttgaaaaagcattgaagctgtgttttaaagtgattggattcagtaagtctgaaggtgctagtgttgatggtgaacttgagatggtcaccttattccttaggaggaagttcatggtttctggctcttggaagaaagtggttgtgtgtatgtatgcgtgtgttataaggggaatgtttttggcttaaactatgtacgcctatcaggcttgggttatttcacagtttgagcatattgtaattctgagtatttttcctgttgaaattggccaaggcaatcatggctatggtagaagtcttatctgctggtgacatcacattctgcttcccaggccttccacctgtattttatcgacgggcatgtaaactacacatagatacaaatatttttcaaatgtgtaatgatgctagttcta

SEQ ID NO: 15863 - DNA, 1126 bp, Homo sapiens
ttatgtaacataacttgttctttacattttaaaaatagatgtagaaaggatgtgttaaaaaaaaaatagctgcgtagaaagcacatatatggataaagcagtgattttaaaaaatttttcttctaaagattttaaaagtcaaatcaagaaagtaaatgaatttggttgttttattgccgaaacagacattttgacgtcatttggcaggaaagccattatggaaacaggttattttttgacaagctattatataaaatgggcagacatttgaattatttaacatcccttttatcttttagacatttttatttatggggaaatcaatatcattttaaggtttttctcttatgtattcattttttattttaattattattttgagtagataatgcatttaattggtttaaaattcaaatgctaataaagggtataagttagagacctttcttttgccctagtccttcacaggttcattttaccacccaagaagcaattagtattacgatttccttgtaagtcctttcagggttattttaggcctacccgggaagatacgtttgtgggtaggtattctccctttttacacatatactagcatcataaataagtttaaatttcatacataccaccaaaaatagtgtctttgcatttgtgtttcaattctatgtgcttacaagtagtaaaggattatcatatttgatctgtacaacttagagaaagcttgcaactttcccgtaaaattttagtctagttttctctatggccataattttcctacttgaaaatgcaactgtgaattctactaatactggtgatattgttcattctgtctttgtttatgatactgcattttttttgctgttttgttttaaataacatttactgctcattttttcaatcataaaagcacttgtttattctaaaaatgttttttgaaaaaaagagaagataaagggaaaaaacccctaccattcagggtagcatctgttaatacttgagtgtgtattactctaatccttttttaaatgcacttgtgtttgcataattttcaacttagctagtaattatatgttacttactgttttgtaacctgcaatatgatggtttctccatgtcattaaatagt

SEQ ID NO: 15864 - DNA, 1133 bp, Homo sapiens
gtaaggtaggaaatacaaagatttaagaaaacagtatatagtaccccatgtctgactaaattatcttttagaattctagagtgaaatgatgctctgatgttctaatctagtgctctcgtttttaaggtcaagggaaactgagacccaaagatgttacgtgcctcatttgtaagggagcttcaagtagcaccaagcaagagcccagggctctttgtggtcactcattgctataaacagggatcagggtctgagtcagttatatagcccttggtcatgtattcgtaaaatacttgcatacaaaacatttcaggaatatcttaaaaaggagaacccatctatattaatcagtttcttctctcatgccgttttatacatacttacccacaaacacaaaattcaggttatcatttatttagacgaagatgttgctaagatttacactggttttaattgaagctgttaaaaccatggttctttttcaagtgattgacaggtcagtgttgaatatcttgagatgaaaaattccagggtagaggaagagatctcagaatccacaggggagggacacaaatgctaattacacattgactttaattcctgatttgtcatagctgcctgcaggtgtatatcttggctgtgggctattctccgggcctcatttgtatttcagattttctttaataatgttgcatccacaaataactgtttaatctctgacttatttacagttcttattctcttgatatgggaaacaattaattggcaggtgaatgtagttgtttcttttggttattgaagattaaaatttttttgtcttcccactgatttccctggaagacagttttggaacagcacctcactttggccttctggcctgagagatacacaggtgttcacttttgtttgttattcctcctattattactcccacacatgtggcatagtgaattagccctcttgatgaattagctctctctctgggttgagagctaatgttcctctgtgctaaacagctgctgtcccacccctgtctgcctactgagaaggagatttggcattgggaggcacaaggtaaccttgagattaacttagtttttttttttaagcagtgctgattttttccctaggtagta

SEQ ID NO: 15865 - DNA, 1175 bp, Homo sapiens
attgcaacttaatggatatttgtaaagtggggtattctttctcttgggatatcccagtttgattctgtctccattgcctactttctgttgggtcccattactagaaatgggcagcttaacatgagactttcctggagctgctctagttctttacttttaaagatatcattataggaattataagaattatgttcatgtccggggatcctggagagtcacttacaggaaagaattaacacaatgaacagatttgggtagtgttttttaatgagtacaagatttttacaagcacagattaagaaaagtagtcttcaatagataaattttggatgatacataaattagtaggataacttctccctcgaatatcttttagtctagttatgtagatggccatacaaataatgtaaacaaggaaatatgaaagagcagttatcaaaagcataggccacctagtatgagaatacagagcaaataacaattgttgaatggaaaagttttcctcagggcgatggcatttgagtttccgagaagatctgctacattttctttgggcagactgggtttgattcatctaggcagaagaagttggcctgtatcagatctcaggaagagttgcctaaaagaaatggacatattaatcaatcatttttctctccgcttttgtattggtgtgtaaatctccctcttagctcttctgctattgagccttcactgctccaccttcagctctccgtctatgcaggcacactgtcacccactggtcatgtgaatgaaacctccaattacaccaggattattttcatctttacaccatgaatcatccccagaatgagcctcatcatacttgtgggtcattcaattacatggttatttaataatttttttttatattcagtgggcacaatgctaggaatacagaaatggatgatacagttccagcctttgagcaaagtaattgtgtctactggagtaaagaatgtattgacatgaagaaaaaaatattttaaaagcataagggtaagcaaaacatggcttaaatactatacaaatgagaacagctcagattttataaaacaataagagtaaatatgtaactgctgtcaaaaaggctgtttcaaaactcggaaatacagaacgcagagaggagtggagccaggtactgacccagccca

SEQ ID NO: 15866 - DNA, 1264 bp, Homo sapiens
tgaacatattttttagagatacatattaaatgaagtgtttaaggttgaaaatggcatcatgtctgggatatactttaaaatgcttccacaaagaaaagggggatagagatgaagcaaatatgacaactttggtagttgttggatctggatggtggttatatggaagttcattagtatcctattttcagtattttgaatttttcacatcagaaaagggttttaaatatatacatacattttatataaatatatattaatgttgaagctccccaggcaattttaatgtagaactaagattgagaaccactagttagtttaggggattaaatttggatcaccatgccctaaaagatgtgttttgtctttggactttgtctaacctaagcctgatttttctggataagttttcatgagtaatctggactcttggtaggtgggggacaggatggcacaaagatcaaattagacctgtatctggaatctgacttcaggagcgtacaactagacaatattgtctcttccactggatgaactcactgtaaccgccctgagagctattataccttggagtttacctgcctcatcacttgccagcactgcatgtcccatcctatggacctctctggctacaccagggcaatggaagacagctgcagctgcattgtaacacatgccacaagaaagccccagtcccttaagagtgctcagcagtttgccaagcggtatttgcctaaagctggggcaagaggactgaaacttgtacctccccccattcccaggagtccacatgccctcagctctgcatccgtatgtgtatgaggcctcttttgtgtcttcagtgcctattccaactcccaagcactattttgctctggctggtcagcaagtgggacgagcagcagcttgctgcagccaacctaaatggagctctggagctcaggctggaagcttccatgctacatttacataccacatccttgctcaggaccctagctgagcaccttttcattcaggggtaggctgctagttcttctttcttggggggttttgtgatttacacctaaacattaagctatgaatagtttatgttttgctaagcaataccgaagcagaggaagcgttatggactgcccaggtcactcagccagcccaaaggttcgcatgacaccctcccttcccattgcccctggacccctgagacagccctttccgccagtgcctgccagtgcacaagtcaccccctgcacctctgtagaagggcctg

SEQ ID NO: 15867 - DNA, 1561 bp, Homo sapiens
caggccttgcccgcaggtcaacgtggggctaaaatgaagaccgctcttagttcatgttctggcatattaatcagggtgacatgataaaaagaatttatctgaaactcatagaacagggcaaggtttaagttcatattttgcagaaaacactttccagccttcatcagcgctaatctgtttttgaaaatggccttaatcccacccactttgctccctaagtatttataggagctgagagtcaaaaaagcacatgtcagaaatcacctttcttccttttcctacccttacctcattttaatatagactttggcaacttctcaaagtacaatgctcagtttttcagtctggttcaaggtgcttaaaggtagtgccctgtaatacaccattataatcaattagtttcccttctccttgtccctttccaacagaaatgaaatgattggtaacaagtatgagaggggtcatgggtgaccttgttcaagagaaagatatggctgcagcagccccaggacaccactctgcctttccccattgctggcttcttggtgagcagcagaaatttggagctgtacaggaatcagatgtcccacctagcaggctctgccggagccagacatagccatccactctggcagcagcctatcgaagggagagaatcctggggcagcagcctaccatgctgccccttccactttagatagggccatgcaatgtaaatacattatttgtatttacatttgggtcatctgcaaaccaaagcgatctcagcagctgctggaatgccattggtacagccataccaacatttatattattcaccctgatgtctagattgctattactgacattattttaaggctttttctcccttaagagaaagctcttccagccctaggctgcttaaatagggaggaacaacttcctttttttttttttttttttaagagacagagtcttgctacgttgcccaggctggtctcaaactcttggattcaagagttcctccctcctcagcctccctagtagctaggactatagatgtgcaccaccctgcccaacaaaccttttttttcaattgaggaatattaggattgagatatattatggactttctatacaacttggggtgttttcttcaggataagtatatttttaatctttaataatgataaaatactttactggcacctaaggaacaataaaatactgactaagaggcctgaagaggcatctgctcctatctctagaatttgaaaccagtcgtttggtgagctctcatgctggagtgggcatggggccgtgtgggtggcagaaaatcaaggggtctcattccactgaaatgtcatggttacctcagcctatggctggtgtttgccctcttctctccaattcggtaaggaagaaagctcctttaccaaagcgtagagtacctgggcagaacacccaggaacctttttctttctctaaagtcacatgatagatctcaccacagcagtcaatttcttgttcttcctaactgcccctaccctccttgtgtagattacatgtctttttctcttcc

SEQ ID NO: 15868 - DNA, 1243 bp, Homo sapiens
cctcatcctctatttctgaaacagcaacttcctccgcaatttcctctgaatgcatacccaggaagctgttttaaacagcctgagttgtgtcttgtggcactaggaaagggagtaatttcttgctttttcacctggtcctagccaagtcccaccctttgctctcctgcagttttctttctttttattgggggtatggtgataaaggagaggcaggaggaacggatctttggtgcctagaactgtgagtggtagtttataagtgtgtgcccatacatatgtgctggcacactgatacccagaaatgatgtatatacccaggaggattaagaattggccctttcttagccaactgctgcaaagtgctgcctgcctctctttccctccttagtgccaaagagttcacacccactcagtcccaattccctgcattagtataaatactagcactgaagaaatgcagggtcctgattcacgcagcctctctggacattattacttggtaagcatcaggagacagacacctaccaccaaaacatgtttagattatttagcacccagagaacagaagcaacactgcctgtgggaaatttaagccaaactacattattgcaggcctctgaaatccaggtcccccaggttcctcgggtagagctggtgctgcctgaccagcagcttctgctgaggtggcatttaacttttggccaggtcccaggagctgaggctgacccatttcccctgcttttccagggcatagggaatttgattatacccccaacaaagccagggactaacacagttagcttgtagaaggtgcactagaatcggggtgcttttatttaagctaaggaaaggttgacagctttagcattttcccatacttgaaaataatttaacatttgtctttcccccatcatacctgtaccctcccctccccgcttttttattaaatagaaatgattggctcataagaatctataggttcagggtcttactcaatttaaccctttggggacattgaattaaaaattcaacaatatttattaaaatacaaaaatacacttttctcacattacaatcagtgttcttttgttggcaattcccctcccccacccataccaccccctttcaaatctgaaccccttatttccttttaaagctaaaataataactgaaagaagttacatcattagatggaccagaataacagagatctctgccttccccacccacgcccaccctttct

SEQ ID NO: 15869 - DNA, 1190 bp, Homo sapiens
tcgagctctacatcaggctgctttgccccctgtaagccagctgggccaggaaagcaccactgaacctactaactggactacagaggaggctgtggggccgtcgttgcacacagcccttctgagctgaaagtgggattgcagcctctcattttggtaacccaagtaccatctagctatggcatcttgctcctcacagcccgtggctctgactgcttcttggatttggaatggtgccaccaaagaataagaaggaaagaaggctacttacaccctaagaggaagagacagtggattcagattgttttcacttgcagtttcacacagggagactgctgtgataacgccagagagagctaaaaaagccagcagtgattggggaaggcctgtgtcagcagcctggtattatagaatgagccctgtgctaagattgggatacctgagttctagtcccctttagacatgtgacaaatcttaaaatagctctaaacatcagtttttccatttataaaatcaaggaaatggattagaaagtttcttaccgctctcttagtccatgattcctgtcccatctcagatatgtagctctgtgaaggttgatcctttggaattgtagccaagtcttggaaatgggccacaaagttaagtgagaatgctttcttcatttaatctagagatccacagtgctggagcagagcaaatcggactgtgttttcccagctactaaaaagacacatagatcacagaatgttaaactaaagtggaccttggagattatctggatttaacctctcactttacagatgtcactgatgaagctcagagaggcacagtgacttacctaaagctacatgactgattagtatcagagtctgtcctttttgacctcagttcctctaagtaacaatgtatggctaattggcatttaaacctgggccttgaagatatttccaaatgcctgtctaatgtgggcttgtatgccagtgcaactatactttgctggattgggataaagaagagtcttcaatagcaccagtctgcacttcctagtgactttgggtcgccaatagaaaatgacagaaatggtcatctagaggacccaggactctcccacccagccaggataattgggttccttagtaaagcccaaggctagaccactccctaacctgatatgcatccctgaggcatta

SEQ ID NO: 15870 - DNA, 1243 bp, Homo sapiens
tggccggctgggggacagtaacctgagtatctggggtgtacccagccttgtcccacttgatcccacaagggctgccttacctgtcaagagacagtggttacaagatcctgttagcatcaggatgcaggaatgtttgtgcctgtagctaaccaaggaaaggtaatgctgagggattctgtgagaccaggaagtgcagaaggctttagggagtgtgattgtgtgtgcatgcattcgtgagtgtgtctgtctgggggaatctgagaatgctggtttcccagctacgaaggcttaactacctccctgctgagtgtaattcctccctgtgccctgtggatgcctcctcagtgaagaggccgatagggctctccacttccttggcaggaggtaacccccacttcctcctcagcagccctgggcagacctgaggaccaaggagggaaccacagatggcagatgcctgtcccccctccttaaccccatctcacacacgtgctcagcagggccctgcacagggctggattggccatcgattggcttttattgagcttggcttccctgctgcaggcctaaaggcctccgccaccttggcccctcgccagccccacccctggagccttgcaagcagcaatgttaaacaggatttagaaaggaaagactccagccagtggattctctgtccacagtcctcatcacctgccaagagaaggacctgggactccctgaggaggaaatgcagggaagagagagagccagggcagggagaggagaggagagacagcctccattcctgacctgcctggtctgtgcctggcttgatgggctctttccctcagggtggccgcagcaacagaacacaaggagccccaaagtgtagaggggacccgagcaagacaggaacttgcatggcagagcagcctggagcagatgaacaggcaggaggggcctccatccacccttcccagtcttgctctgtagctggggccaccgggggtaccagcagtgccccaccaggggcagagctccaccctggccttggcctggagagacacttcccccacctgaccgcaaaccctggcatcagtcagctgggacagcctctccacaatagcaggcttagtaacagcctctccacatgcttagaggtggtccatgagaagggcagactgtcctgtggttggctctcccagcattcctgggccctgctgcttaggtcaagctcaggacccctgttctctgcccagct

SEQ ID NO: 15871 - DNA, 1258 bp, Homo sapiens
aattcccttgttggttctgatgcctgccagaatttgagaactgctagatcaggactttagagaactcacctttcccctccgagatagagggcttcaggggctcagcctggtgtgaatcgagtgccccacagtcactcgcccagggccgatcccatttgcccaaaacccctttcccagtgtcttttttttttcttcttttttgagacggagtcttgcactgtcgcccaggctggagtgcagtggcatgatcttggctcaccgcaacccgtgcctcccaggttcaagcgattctcctgcctcagcctcccaagtagctgggattacaggcgcccaccaccgcacccagctaattttttgtatttttagtagagatagagtttcaccatattggccagtctggtcttgaactcctaacctcgtgatccacccgcctcggcctcccaaagtgctgggattacaggcatgagccaccacgcctggcctcccagtgtcttttatgacttcacttcctcgccctcttctcacctctgccgactgaacatgcaggtctgggcccactatgaggagcagcccgtggaggaggtgatgccagtgctggaggagaaggagcgatctgctagctacaagcccgtgtttgtgactgagatcactgatgacctgcacttctacgtgcaggatgtggagaccggtgagtgctcaggccgctggctcgtggttcctggcttggtccagctggcgctgcctgggggtagggggcctctgcccagtgggtgggaggaacaatgcctaggcagtccaggagcctcccctgaagagctcacgttgccgcccctgtctccctgccttgtcccactgctcctctgggcttggagttacttcaggagccttcacatgagccctggcttgggctcaggcatggaggtgctgccggacaggtcctctggacgcaggtgagataaccaggtttatctgggtggagctctgagtctcttaggtgattgtttgttcctacatacccctggctatgctgggcaggatgatttgtagcccccagaatctgtcaggcaccagccaggcattgctcagcccgtttccctctgggggagcaaggagtggtgctgggtttgtctctgctggggtttctccttctctagaggttaacatagccctgagtgatagccagtttccatggaaacaggcagcgctctaggggaagacatccccgggcagtctctgaaggaccttctcctccttccgt

SEQ ID NO: 15872 - DNA, 1258 bp, Homo sapiens; identical to SEQ ID NO: 15871

SEQ ID NO: 15873 - DNA, 1135 bp, Homo sapiens
tctgtcacccaggcaggagtgcagtggcgcaatattggctcactgcagcctccgcctcctagcttcaagcgattctcgtgccgcagtttcccaagtagctgggattacaggcatgcaccccatgcccagctaatttttgtgtttttggtagagatggggtttcactgtgttggccaggctggtcgccaactcctggcctcaaggggtccacccacctcagcctcccaaagtgctgggattacaggcatgagccaccgtgcctggccaacctcactagggttctctggggagaaaattacaggcccctgctggccagactttcttgggagtctatggacaggagctggggcccaagtggttgttctctggcttgctctgacctgagtgtgtctctgctccaggatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtggtatgtgatgtggagaggcggccccagcattgcgccaccaccctcacagagaaagggactgttccacaagccaggaagggagcagggaatccaccatcctgctgttcctgctgaggaaagataatggatttgggtttgttggtgtttttttgtttttgttttaaagctaattacatcccaaattaattggctgcgggtttggctgagaatgcagctgcaaactagagcggaaagcttccctccccatgtacccccaggtgacaggcgagaaagctttgccaggggctatgtggagagggtcaaggcctgtccctcccgctctcccagtctcactgtccaacagacagcttccaagtcaataaccaactcctaacacccagtgccaccccgagccagagctgtcgaggaggcagcaccaaagggcccagaaagactgccacacaaccctctggctatttggaaagccccttggacttggagtcctgcctccactgttctgagaggagaagccagcctcctgagccccatct

SEQ ID NO: 15874 - DNA, 2180 bp, Homo sapiens
taattcagctctgtagtcttacacactgcaggaactgtctaagcgagagcagagagaaatgctttctaacctaatcgctgcaggcggagacacttggaaaagaatggggggaggtggggcctgacagagagcagcacttatgtgtttgtcagatgaggggatttccagttgaattggcctgcagtggcctaaagacactagcctggttagcgatgacctgcatttctctcatagagcacctcccttttcatcgtatccactagctctctaagtcctccttaatgaggacacttgatcctcattaagtctgccccttaagatggcttcacacctactgaaaaactccaggggtttgacatctcactttgattgaaatcttgtcttcctataacatttgattccctgggctcttcagccctatcacctctgcttgtctttatccactctcttcttcattcacttttggctacacaggccttccttccatctcttgactcttgaccacctcagagcctttgtatccgttccctttgcctggagagtttttcccttgcatcttttacttgtcactcagatctccactagttgtcgcctcctcctggagctcttcccagactatctaaagtagggcttttcttcccctcccctctatcttgcccccttactgaaatctgcttccctgtttcttcttcttttttttttttttttgagatggagtctcactctgtcgcccaggctggagtgcaatggcgctgtctcagctcattgcaacctccacctcccgggttcaagcgactttcccgcctcaccctcccaagtagctgggactacaggtgcacgccaccattcttggctaaattttgtatttttagtagagatggggtttcaccatgttgactaggctggtcttgaactcctgacctcaggtgatccgcccacctcgacctcccaaagtcctggtattacaggcgtgagccaccacgcctggcctgcttccctgtttctttctagcactaatctctatctgaaatcatttgtctctttctagcactaatctctatctgaaattgtttgtctctccagttagaatgtatgctttgtgagagggactttatccctcttgttcactcctgtagacacagcacctagtactgacccaggcacgtagtaagtattgaataaatatttgttgaatgaaaaaaataaggtaggaaaggaagaaacagtattcagtaggcaagagaaaaagttgagaacgtggcccaaaattcttgattgcttagtctagttgagtgttacaaataatgctttgacagaaccattgctgagctagagatatggttatttcttttttttttttttttttgagacagtcttgctctgttgcccaggctggagtgcaatggcatgatcttggctcactgcaacctccgcctcctgggttcaagcgattctcctgcctcagcctcccgagtagcggggattacaggtgctgccaccacgcccggctaatttttgtatttttagtagagacgggttttcaccatgttggccaggctgatctcaaactcctgaccttgtgatctgcccacctcagcctcctgaagtgctgggattacaggcatgagcctggttgagacatggttatttcatcgcaatatcttggggaacccatgaatgctctgaaatgcctttggtttagaaatggatgaaggagaggccatggaaatatttagaccttttggagagatcgaaaggacaggtgatttatctccaagttcacctcgagacatgacttgggctgtcaaatgttcttacggtagcctggcaacatgtctttctcagcctggtctgtacagtgtggaggaagtaagggactttattaagagtgtcacaatagctataacctgccagtcaggtgatctgtttttccttggccatctctccgtctgctcaccactcttttttccctagtacacgaatatctttaacattcaaaaatatatcttaacacttaggatagatcaaaattggtgttcattcagataacattgtcagattctcttagatccaaatatttcttttaacaacttaacagtatgttaaaacctcattcacttgcttggagagctgttgtacagttctttaaagagttctttatatgaggttgaatcttccct

SEQ ID NO: 15875 - DNA, 1141 bp, Homo sapiens
tctttccaagtagaacataagctccattagatgagctgggaactcatccaccttgttcactgccatgtccccagggcctgtcctggtgccggtgcatgtaggagctcagtgagtgagtgtccagtgggtgataaactctttacgtgggctgtgcctccatcctcaggacctgacctcagccctgacccggaagatcacgctgaagacgccactgatctcctcccccatggacactgtgacagaggctgacatggccattgccatggctgtgagttacacacctgcatggggactccagggcacacaggaactgaccatggtgggctgtgctgaggggcagggctgaggaggaatgggccccggctctgaccacacttcccttctacatcagctgatgggaggtattggtttcattcaccacaactgcaccccagagttccaggccaacgaggtgcggaaggtcaaggcaagtaccaggcctgtccccagcaagatgccacctggcagtccccacctcagaggccctcccagcctcccctgccagccctgcactgctacactccctgcgtgtccttcctctcagtggagccttggggccgagccctcattttcccactggctcctcatcccactgagggtcctggcttctctgcagcacagctgcatcctctgttccctgtggccagcctggacatcatccctggctttcttccagccttttcctcccccatctctgcccgcagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtacctgcagggcaggggaagcagggctgggtgtagagaggaccctcacgctggggcctcagactggtgcctgtgaccagggaccagagggaggcctggctccttctctctcacctgccaacctgcaggcaaatgttcctggccccacaggtgatgacgccaaggattgaactggtggtggctccagcagg

SEQ ID NO: 15876 - DNA, 1193 bp, Homo sapiens
aatgtttaataaaagtagcaataactgacatttgttgaaagccaactatgtgccaggcattgttctaagcacttagatatattttctcatttaaaccttacaacaatcctatgaagccggcaccattgctagctccattttacagataaaagagaccaagacacaggccaaacagctagaaaatggtagagttcaaactcaggcagtatgggacttgagagccaccactgccttccagatgtaactagaaaattcaagccttctagtagccttaataccaatagtgaagcataacagtgagttacatagttcaggagccagagttccatgtgaacttggagctgactctgagatctgatgcctggagctgtagcccaaaactaaatgtctttgtactgctgcagttttacctgtgtcatcaattatttcttccttgcatggttttatctttattggaaattgatttcccaccccacacattttcatgttttctgaaagtcttttaagatttgacctaaatttttgttttctagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggtgggtgagatgaaggattctgaacagggactcagtttctctttttgtggcttattctgtctttcccctttagccttatatagcatatcttatatatatatatgctatatagcatatcactgtatatgctatataagtattggccagattcagaatccaaggtctgtcactgtttttctgtgaccttgatcaaggtgccttgggcattctgtttagtatgataataccttctgtcatataatgtattttgccatttcattggtagcttcatattgtaagaatggggggaaatcccattatttaaaatatcccatgaccaatagtcagacattgagtaataacagtgatactaaagaactctcacagaaggcagttactgacaacatagactatctatagctaaacacataatcactggtcacatctcctgttagtgtgactttagcatgactaaggctaccaggtagatcatcatgggcttgatgggatagtt

SEQ ID NO: 15877 - DNA, 3027 bp, Homo sapiens
caagagcgaaactccgtctcaaaaaaaaaaaaaaaaaaaaacaaggaatgtgtaattgctgttttcttccctcttcgtatgtatgtagggggaatgagggctgagtagttcacacttaatttagtagaaatgagaatcttaacttctgattaaccccaattcttctataacagtgtttctgaatttttaatgggaaatatgttcttcttcaattcattgctatctctactttcaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcattatggggtatgtatgaccttcattttccaagaaatagaactctagcttagaattatggatgctctaaaatgtcagaatgggaactctcctcgaagttctcccaaactcagagacagcactgccttctcctaaatgattattcttttctccctgttttctggtattttctagcatccttctcaccacagccataacccttttttacttccattaggccgtataactggagagacctgctgctcgttatataattatctgataccaaacacaagcgattctgaatgtacacacacgtttatctatagagcataaggtaaaacaattttgtttaacattttggtattgtttacaaatgttattaaaacatgcaaattcattt

SEQ ID NO: 15878 - DNA, 1201 bp, Homo sapiens
gaaccaaggcccaggcagcagaaaagacatgcaactgctctagcttacctgttttttaacctcttgattcctttctcttttccctttgttttctcatcttcattatctgttggatccatgcgtttatgtctcacatctcctggtctctcctcgtgcttctttctcattttggtgtgttgcagtcatcccctacccccaatccccccatcttctccttgcctcttgtaggcctggtggtcatctcggctttgctctggtgctggtgggctgagacgtcgtcctaatgcaggtactggtattgcttcctctccttctgagggatagagggagggtgcaggttgccctggcctctcctctttcccttttctcccagctgcttgcttcttgcttgtgccattttataataggtgatgctcaggtctgagttttagttctgacttttccttgggctactgcaaagcctctgacatctctgagcatgtcttcgtaatgcataggaggttggaatgcttgccagagacatggtttgtttcaatccttggctgggaaaaacttggataagcccagcttggttgctgctgtcaaagctgcctcactacttctttatccccgctcatcctctgtgtgatggctagcctgaccacttctgatgagctgatatttgcaaggctggcctggactctctttgtcttggtttaactccggagccaagttctcactactgttgctacccaagatggcaaaataaggaatccctcttctgttgggagagagaggagctctgaagagctctgatcctcatgatcctcccaggggcattggtaggagggcaacctaagctggtccatcaagcttggtgaaatggaaccgaacccctactgtattctgctctttctactgaacagttctctgcttctggacttccagtctccggaaaagtcagaacagaatgccgggaaattttattagttatctatttatctattttgtgggccagattccatggtaattggcttccccagctaggttttctggagagaatgaggtattagtgaaaagtttctactagccagagatgtgtgttctcaggaaatcaagactgatatattctggccactttcctgtcagctcccacacatgtaatgtacactgtcaacaggataccaaattcaggaggcagaatgtggtcttacggcctaag

SEQ ID NO: 15879 - DNA, 1208 bp, Homo sapiens
ctgtacagtaatgagcttcttctctcggggtttgcggtcaggccattcttccccaaagcagaagaagatctcgaagggtggtggggtgttggtctggcccttttggaacaggatgagctctgcatcaaaatcaaggtccctagtcagaggctggaaccatgccctgggcaagaggcagccaggaggatcacagctttgggccctcaccattgagaaaatgctccaggctgaaaagcttggtcttgacctcccgctggatggggttggggcatgagtcatgggctgaggcacaaggcccgctccagaacaccttgcactgacacaggcggatggcataaaggtcctggccctgtagctggaggatgagcccgcggtccaggacatccagcagctggttcgtgtagaagcgctgcttgtcactggggatgtcctcagggctggggaagcgcacttgctccaggcttatggggccgaagagttccacctgctcctgggtggcctccagctggctgtagaagagccggcagccatgggggttgctgatggtgagggcccggggtggccgcccccggtactgaaacttgatctccaggtcggtcactgtggggcagaaggcaggcccatcccgtccttgagccccacgcctccccattctgcagcccagtggccaggcccagccccatccgccctcccacttttcccacccaagggagtccagcaccctccaccctccttgccaatcctaccccaatcccccagcactgcttccccgtgcccagccatgggtccttacgaggcagcatgtgggggctgatcagcaggtctggcaggagctgttcgcctgcagggggcaggctggcaggcaggggcccaggctccaggacctcagagagaagctccctgaagccagcagggttgccagggggaggagccagggggctggggtctggagcagggggacccagcaccacgggcggctgcagagtgggcggctgcagagtaggcggccgcagagtgggcggctgcagagtgggcggccacttgacatcctctttgagtaaagaatagggtgtcatgtgggggccagactgcactgcatctacagagagtgcgtgtggacggctgtcagtgccacctccacgaactgcctcccaggcacacctcctcccagccctgggccaccctagcctcccatcagcccccttcca

SEQ ID NO: 15880 - DNA, 1720 bp, Homo sapiens
ggcaaagccttctttcaaaataaaatcgacatgaagcctgtgggatttagcagactgaggcaaagcttccctggttgctttggaatgggaggcctggacctgctggctctttgccctcctgacacatcatcccttgtttccacagcacactcagcattggaagcacactgcagacggtgtctcattaaagcagtagctcccttgaacccacaagttaaaacgccagacttttatttatttgtttattttttctgagttcttattggcagacttcagaatgaggtacctgaggaaatatagaaacctctgccttaaggttgattttactaaatgctctattttctggtgcagttattgactgtcttatctcttttgtcaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaccagtgtttctttgtttttactttcattcactgccttgtagctcggaaatggttcagctagactagctatggaagcagcctttggtacctgatagacatctggggatggagttgaaagggcaggcccctgccctgatgcc

SEQ ID NO: 15881 - DNA, 1108 bp, Homo sapiens
gagcagtttcctcccctggtgtttaaccattatgagatggaaagtgtgttttcatctgcattgaatccttggctgtaggcactggtatctgagttagttgagccagggagagggctacaggaaggcaagcatattaagaattgcttcctggctgggcgcggtggctcatgcctgtaatcccagcactttgtgaggccgaggcgggcggatcacaaggtcaggagttcgagaccagcctggccaacatggtgaaaccacatctctactaaaaatacaaaaaaatagtcgggcgtggtggtgggcacctgtgatcccagctactggggaggctgaggcaggagaatcgcttgaacctgggaggcggaagttgcagtgagctgagatcgtgccattgcactccagcctggatgacatgagcaagactccatatcaaaaaaaaaaaaaaaaaaaaaaaggaagtgcttccttctccactgctttagcttttagcttagccttatgttcatttagcaaaaactgttatgaagacagatacagtagaatgaagctggcatcagctggtttcttggtgacagttttggacaaagggaggtcggggggcttttgaaaaaacagggtcagttgaatattgggctattcatatcacataggcatctcctgctttgtctctctttctacatgctttaaccctttcctctctccctcctcctcccacaggaggaaatcctgagcagcctgttcaactagaaaatcaatgactggtggagacttagttgctagaccggcctttgtaaacaaaatctatctttggaagagaatgaggaaacttatgagagccgtagcaaccaagtgttgttgtagcagcctacatttattgaatactattttgttcactgctctattttcataagcactctgtatgtggacgattttaatcctctaaacagtgttatgaagtagataatattaatagatgaggaaactgagacaaagattggtaacttgttcaagggcacagtggagccaagattcaaactcgggcagtttgtgtccagagtacaccctttgaagaccaccaagcttataacttttctcatatataataatt

SEQ ID NO: 15882 - DNA, 1172 bp, Homo sapiens
caaaaaagagagagcgagtgtgtgtgtgtgtgtgtgtgtgtgttcatgttcgcatgtgtgcatatgtatatatgtcatatacgttatgacaggaacaaaacaatagcctcatcccgaagaaacttcacttctaaggtgtagaaagtcgttttctgaaatgatgcccgctgcccctttgaagggaagtctaggcatgcatatgcagactgcatcaacccagagggtttgaagggctaatgagagcacttttgttgattcctttacttgctcccaagtgtagggaagtaaatgctactaaggaaaatttgtggggttttgttagtatctgtagggtctcaggtgagtaagctatgcttccttttaaaactcttacccctctttcctatacagactttttgtcgatggttagaaaattccttaaaaggtttgccaaaggaaacaaccgtgggagccgtcacagtgacacacaaacaacttacagacttccacaagcaagtcactaggtgagtgatactgggggttcttaaggaggtgtgggatgtgggaagaaacatatctttatttcttatgtgcccttgggaaatggacaatttatagtttgtttaaccttgaattgcacaaattggcattggaagccaatctggtgggaaaacattcaccatgctgtgtatgtatgtacatatatttaacatatgtgataactggtataagattttttaacggtaagtggaggcactgtttctcccaaaggaaaatgcactgagcagctcactccccgtcaggagatctgtctatatttttctaagtccttctgagttttcatccacattcgggggtcaggaatgtaggtacctgagtaaggcaaagcattggttataaaacatcagaaagtgatgtagatgacagtgaattggagaatgttcaccatgcctaaagatagtcaaattctaatttcaaagaagttgtgtagtccaaacagaacatctgcctgggatacattaggcccatgaggaacttacaatctctggattacagcctaaaatgtaaagtgtgtgtgttttttttactgtgaacatataaatatttttaatacagttacatagtcttcctaattattgttttatagccataaaggtgttacttgatttccttataatgcctctattagtaga

SEQ ID NO: 15883 - DNA, 3047 bp, Homo sapiens
atcctctatgttctgtctattcatcccttcttccctgaaaccccccaccaaccactgatcttttttactgtcttcatagttttgcccttttaccctggctgcttttatagcctaatcttgtcatttatacctagtctcactttccacaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatgtaagtataaaaatgataccatttctacttaacagcttttatctcctatctctttgtcattccttaggagaaaaccagcatcccagtatttccttacttgatctatattggtagacatatatcatagtggatcattcactagccaaaatatcaactaagacacttgtgctgggtgctttaggctatataaagcagtctaaaactgttcatgctcccaaatcatttggtgtctagttgaagagagaaacaagtttaaagagttaagtaacaacaagatgccagtgtttggtgtttttcatttgtttttgaaacagggtcttgctctgtcgcctaggctggagtacagtgatgtgaatctcaagggatcctcagctactgagtagccaggactacagacattcaacaccatgcctggctagtttttatattttttgtagagatggcatttcaccatgttgcccaggttggtcttgaactcctggcctcaagtgatcctcccaccttggcctccagtatttgattgtcagatgagtgataaaagtcatgattggtatgagatcagacgagggaaagctctagaccaaaaagagttggaataactttatggaaggggagggatttaaatgaagccatgaattagaggtagaattttgatggattagagaggcagatagtcatactgcctctaagccaagatcagagcaagtcagaatagtactaagtttgttagtagacaactaagcagtgggagtagtaaagtgcttcacaggaatttcgaaggtaggtttgattagatgtggagtagaattgtagacaggggagagcagtgaagaagtaagtattctgcattctatttaggctattcatttaagaagtttggcagtaaaagagagaagaaaataactagaagggaaaggcaatttaaaaaatatttttctcaaggtattagaaatacatgtgtatttaaagaccacaagaagggccaggcgcagtggctcacgcctgtaatcccagcactttgggaggccaaggcgtgcagatcacttgaggtcaggagttcaagaccagcctggccaacatggtgaaaccctgtctctactaaaaatacaaaaattagccaagtgtggtagtgtatgcctgtaatcccagtttctagggaggctgaggcaggagaattgcttgaacccaggggatggaggtttcagttagctaagatcaggccactgcactccagcctgggtgacagagcaagacgctgtctcagaaaaaaaaaaattaaagaccgcaagaagaaaaaaagggttttttttttttcgatagaaaaaattagatctctgatagacgtcttcaattctaatttcagttggttttgttttgttttgttttgttgtgacttggggttccggctgtgttacccagacagactgtagtggccattcacaggcgagatcccactacagatcagaatggaattttgacccactctgtttctgacttgggctgttcacccctccctccttaggcaacccaggagtggttcctcactcctgggaggtcaccacattgatgctgaacttagtacaggcacccaattggtatagcatgctctagcccagaacactgggttcaagctgttcccctacctgcgcctttggagtggctgggactatggtgtgtgctgccatgccaggctgacttagtttttaaaaaaggaaataggaacacaagttatttttcacattaaaaaaaaattaataccatcacatagaagatgaagagaaaaaaattttaaaaattgctaactttaattcttaaccatgttttctgccttcaaatcatgaaaaatctaagcattaatctctgttgaaacccatgttcattccttggatactaataaactccttcattttctttctaaagacaaaaaacttctggactttgtgaatccagctgtcattttacacacacctgcatacacacacacacagccacgcgtgcacacacacacacactttcctattaaagagaaattactaaaggggaaagagtgcttggtctttgggaagttgagactagaatttatctgatgttcctgctttcctacatacagcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccggtaagattgttttcatgaggaatttatctcatagtccctaaatgtaataggctttggttccttaaggccaaccctaattttgaaactagccctgttttctgtccatggaaccaaatttaggcatattgccaaattagattggtagatgaagaggcccgtaaagatcagtaatttattattgagttctttaaagcatgtttctatgtcactgtcatagggggtatattaccagaagtaagtatcaagcattgaattcagttgtgtggctgtccaatgtgaaatttgttcacttgtgagagatgcccaaatgtcagttatattagttacgtattactcaagaagtatttaatcctttcagacttattctatagcactgtattatttcttggtgatacatctagccagaacatttggaagcacataattgtcaaagtaacccacaatgtacagttggatatat

SEQ ID NO: 15884 - DNA, 1293 bp, Homo sapiens
cctaagtagctgggattataggcatgtgccaccaccagcctcccaagtagctgggattataggcatgcaccaccaccagcctcccaagtagctgggattacaggcatgcgccaccacgcccggcttatttttgtatttttagtagagacgggttttcaccatattggtcaggctggtcttgaactcctggactcaggtgatctacccgccttggcctcccagagtgctgggattacaggcgtgagccaccacacccagcccatatttgggtttataaagggaaaaatggaaaagatagccatagtgcctcacagcccatctacccaaagttggattgaatttgcgtgttctattggaagtgacttaaaggtggccaaaaaatgataggatgatttaaaggatgtgcttataaaggtgatgtaagtaaatgactttatcatctggttttctttatttggtgaaaatgatactaagtaagcaagcagggatcagggctctgggtcctcagtgaaattggtctttgttcactattttgggctgttgtcttttcccaggcataccaatcccattgtggaaaatggacagactcatccgtgtcagaaagtcatacaggaagtaagtgctaatggatgcttgtggaatcaaggcttgcttcttttttccttacagggctttgggtaactcacctgagaagatactgtcttccaagttcatagggagattcagtttgttgatgtggtttcaatgaaatgagggacagagccatccaaatgtcttttattttagatttgataacaaaacaggctgcaagggaatgccttgaaagaccagagaagtggtagaaagagattcactgtgtgactcctagagttactaggaggcctgatcaataccagcagaatatttttgacaaagctagtgacttcgttttcctcagtgatgacatacttcccctctacttttttcactgaaggttatgtgaggatcaaaagtcatgttttaagaattgcttttgagacttcagaggacaaattacatcaacactaaatactcttaagtgtccaatggtctcaaatgatgccatttccttaactctagtccttttgttcaaattcttccaccttccaggaactatctttaaacatctcttcctatatagctcgtaccaattcttttcatagcctttcgggaagtctgaagtttaggaaattgtgtatctctgtcatttagcaaagttagacatgctcttccagttctaaagaggcactgttttctcttgttaagtgatagggt

SEQ ID NO: 15885 - DNA, 1214 bp, Homo sapiens
tgacttgactgttacacatttaaagtacatgttcagaaagaggctataattgaaagaaagaaagaggctctaattgttttcctattacatttatccatcactatcttcaaaggattggttccaggaccacccactacccctgcccctctgtgcacagtttccaagagatgcagatgcccaagtcccttatataaaatggtgcagtatttgcatataacctatccacatcttcccatatactctaaatcacctgtaaattacttataatacctaatacaatgtaaatgctatgtaaatagttgctatagggtaatttttaaatttgtgtttttcattgtattattatttacttatattttgaatattttctatcgatggttgattgaaccctagggtgtgcagggccaactgtagatcactccttagtgatcatacttcttgcttccctattcctgctacctccccagcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaagtgagtaattgtttaagtctggagccctgggtttacctacagtctggtcattcttttaagtcactttttattattcgtctgtcatttgtgattctcagtgattctgtaaagtacagatagtgcttcctaaagatgctctactatgctcttctgaacctagagtggcaaattgggtgcagggtttgtagaattaccatagaaaggtaaggctttaaaagttggagacaaattttaaaatatcaagtgtgatttgatgggagtttttattcaaatgttttaataattgagaatttgaactgacaagtcacttgcgtaggagtgtacgatctaggtaaaggtgtctgtcatggggattgtgatacagcatagtaaataatcactagatgtcccttagactgaggaaccttttatttatttgattaactgtgcctgtatatacttataatatccagatttctgactcattgttctcattcccctgtcttctacagagttctgaattactgccgtattttcactgaactatgtgaaacttttcttgaaaaaattgtttgtactccaggccaaggtc

SEQ ID NO: 15886 - DNA, 1234 bp, Homo sapiens
taacaatcatgggggaaggtgaaggggaagcagacacatgttcacacggccggcaggagagagaaggaggggggtggtgctacacactttgaaacaaccagatctcgtgagaactctatcacaagaacagcaagggggatgttcattcccatgattcagtcacctcccaccagaaccctcctctaacactggggattacaatttgacatgaaatttgggtggggacacagaacgaaaccatttcggggattaagtagataagttgtatttagaacagtggtgcctagctggatgcagtggcacatgcctgtagtcctgcctgggcaatgtagcaagaccctctctcttaaaaggaaaaaaaaaaaacagtgacacttaaacttaaaaagcacttttaaccgttggctgttttattgccatctttctcattattatacttgtaaggtgattgaaataatggtttaaatatatagattaacattattcattttaagtttttttctctattcagatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttggtaagtaatgaccttatttatcaaagtatttctgccaatcacttttcgtaactaacctgctgggacataaaaacgtttttaaatttttgcacagtaactggaaggcgtgtattaagaatgcagcaatgttccttccttgctacgaggtaccaaattagaagtatcagttttaatactcctaataggatatagttatgtttaagaggaaaacagtcttatatgttgatacatgatttacatattaaaatccaaataaccattggtatctttttccttgttttaaaaatataaaattatgtatttcaataatggtcattgaatcctagacatttccatgatataattatgtgtgcatcacaagtttaggaaaaaacagaacaggaagaattaaaaattatgtttagtgcatccagagacaattatagattaagatattatctttgtagttgagattagttaaacatcgtatatgcaaaatggatttgggtttttgagattagtagaataagtactaatgtctttttatatacttgtgcgtttcttctttaagctttgaaagtagcagtgcctagtaatata

SEQ ID NO: 15887 - DNA, 1191 bp, Homo sapiens
tcttagaaatggggaaactggccgggcgcagtggctcacgcctgtaatcccagcactttgggaggccgaggtgggtggatcatgaggtcaggagttcaagaccagcctggccaacctggtgaaaccccgtctaaaatacaaaatttagccgggtgtggtggtgggcgcctgtagtcccagctactcgggagtctgaggcaggagaattgcccgggaggcagaggttgcagtgagctgagatcacgccactgcactccagcctgggcgacagagcgagactgtctaaaaaaagaaagaaaaaaagaaagaaagaagtggggaaactgaggtacagagaggccaaataatttgccaagccagccctgggattcaggtcctggaagtgtatctccagccaccctgccatgctacctagatacctttccctaaacaagaggctcgtccctgagctgccttgacaccgtcttttcccatccctggtgccagaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggtcagccgcgggagggcaggcccggggggccctcagcctggaacgtgggaagagagccagagggaaggggggcaaagaggtcttggtgggggtccccagggaagggtcatgatcagaagggtctggggctcagttaagggtgtctgtgtcagcagaataaccctaacctcacagaatggcccacttctctcttctaggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacgtaggtgtcttggggacccagaggtgaaggtacagggaggaaggctgaagtgtgcgtttaccccaaagggagcaggtgcgtgtaaaaccgagatccagggcaggatctggctctgccctactgca

SEQ ID NO: 15888 - DNA, 1176 bp, Homo sapiens
ccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccatcttttgttctcctatatcctccttcttctgttccatttcagttcagtttcagcggtgccaacctctttgcgtttcctttttgttgatgaggacccagagctgctgcacacactcacctctaaccccctcccctcgctgctgggccccatctccacaggagagactggttcagctctagggcctcagtctggagtgggataggagcagtgagtgacaaagcctctgaaagatgcatcatctcttcctcacacccatttagtgggggatgggtcctctagacttgaggggctaccctgggaagctgccgtagcttcagccaggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtataaactcttggtgtgtttttccttttttttttctttttctttctctctcttttttttttttttaattgagataaaagtctcactctatcccccaggctggagtgcagtgacatgatattggctcactgcaacctccgtctcctgggttcaagcaattctgcctcagcctcctgagtagctgggattacaggtgcctgccaccacacccagctaatttttgtatttttagtaaagagggggtttcaccatgttggccaggctggtctcgaactcctgacctcaagtga

SEQ ID NO: 15889 - DNA, 1163 bp, Homo sapiens
ttcccctcactgccaccttcaaaagactcttcaaggccttaaatagtattccccttcctgaatttgccttttggagatagagaggtggagtttgggtaagtggctatttgcctcattaaataaagttccccttcctcaattcctttccccatttcatcttgttgctatgatttttatctctttatggagaaatattggcctttttcaatgatgtgaaaaggaaacacagttatttcctgtcactgtacactccagaaaagtctctgcctccctgttacacctttaggcaggctcttcatgtcccagcatccccattagctgataacatcacagtctcatctttctttttccctccaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgt

SEQ ID NO: 15890 - DNA, 2062 bp, Homo sapiens
gtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctgtagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagagcaatgtgtcttctttcctccaacctcttaccttagatgcatcctggttatctggaagcatgggaaagaaggctacttatctctttgtatgtggctccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatggactcttaagggtatttcttgtttctgtgaactagaaattcagagatgagagagatctctgggcaacaaactagagatcctgctgtagggcaaggatgtgaaaatgttaccaatgggcatgtttgaccttaggatgtgaaaatgttaccaataggcatgtttgac

SEQ ID NO: 15891 - DNA, 1169 bp, Homo sapiens
ctaggtgctagagtaacaaatcttgggccttgtcgtgtagagcagaaaggtatgggctcaactagctatgttacaacttctagagaaccaaaatagagcaaacaaagagtggtgtgggattataggaggagggagaaattccttctagggagaggagaatgatacacagagaaaagtgaggttagggaagacttttcacataggggaagtttgagtaggacttggaagggggagtagctgcattactgatggagaagaggggctgagaggaagggcatcagtagtctgatttgagaactagcaagtggattttgctcgacttggagaatagtggaaagtgaaactgataaggttgtggccatattgggaagagtttgtaattccatgctcatgagtgtgaactttattctataggcatttagggaccataagaggtttgagtaggacatccactatggtttttaaaaagatgacatgtaaagatttgactagagacttgtgagagtattgaattgtgatgtaaaaggacatcgattctggggataatttttacttcacagttgtcagatttgagtgacaattgagtaaagagttaaagattatagtgtggttattgggtgatgatgatgcctttaagatagggaatgtataggaagaacagaatttgaggaggaaggtaatagagtatgactccagatgtgttaagatatctgggaatcaagaaaggtcaagtaagtacctgggtatttgggctggagctcaaggggacattgggataaattaggggatttgcattcatcagtataatgccatatagaaactgcagaaagccaggcatggtgcctcacacctgtaatcctaacactttaggaggccaaggcagaggatcacttaaggccaggagttcaaaaccagtctgggcaacgttgtgagaccctgtttctacaaaaatttaaaaaatttgtcaggtatagtggtagccacctgtggtctcagctactcgggaggctgaggctggagtatgacttgagcccaggagtttgaggctgtagcaagctatgatagggccactgcactccagcttgggtgtcagtgtaagaccctgtctataaaaaagaaagagaaaatagtacagattgagtatcctttatccaaaatgcttaggacca

SEQ ID NO: 15892 - DNA, 1199 bp, Homo sapiens
ttgagaaaatgtgattttgactaagaagcagtatttctggaaaattttttcactggctctcttctattgttgttacctgcaatttcatcatcttttcatttaattatgttcagtatgatgtctttgggaccagtgggtatttttatttgcttgtagaagtgtttgtttttaaggctatgcaatggctcaggaaggccagccccacccactctcttgttgcttggcaccaatcctccctggttgttgggcatcttgtttacttctgcccttaattccctgcaggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggtgaggggtgggaggtgaggaggagactcaaagacaagtggcacaggtgtgggcgggcctctgatcacttttctgcattttgtcctcagtgatctgaccagggagtgagatgctgactggagtcttgtagtgaaacagtagcagccttggaaaagacattatagtgccagaaaagtgctcccaaccaagggcatggctgtggtctcctctttcttctggcagtttttttttccctttcacttgggcctttgggttggatttaaaaaaaaacaaaaaaacttttagcttggggttggtctgaacaaaagaacattaggagtttaatgaatcacagtcaaggtagccaagtaaacttttagccctcgggctgctctgctcctctttcaatgtaaattctaaatacttccataattattactaagtacagcttccttccgcaagaatgtaaaagtcagagtgacagtcttctgagtcgttgatttcctcttcctttttaaaatttttatttaaattttacgatttctaaagatgagggtctcactgtgttgcccaggctgatctcaaactcctaggctcaagcgatcctcctgcctcagcctcccaaagtgctgggattacaggcatgagccactgtgccagcctgatttcctcttcctttaagaagggaagtcaaaaatgtacttagcatgataaatcagcataccttagtaatttttatgaaattatcccctttatatatttttagtttagcttcatcaaaatcaaacaccttttta

SEQ ID NO: 15893 - DNA, 1161 bp, Homo sapiens
ccaccatgcccagctaattttgtattttcagtagagatggggtttctccatgctggtcaggctggtctcgaactcccgacctcaggccatccgccctcctcagcctcccaaagtgctgggattacaggcgtgagccaccatgcctggccacgtatttatttttcatttagcttggaagtttactgagaatcttaatatgccattcttgatcagaataatctttctttgcaagaagtttaagagtttggcctcaggttggaatagggtgtaaactagactttgatcaagaagaaaccaatgagaagccctctttgatacttcgtacacagcttctttctaccagaaccagtctgtgggaggtaatcctaggagagtctaataagaggtttggtttggtttgatttgataaagaagtagctgcttattgcatattgggactaaataaccaaagttctttgtggcttaatgtgcttttccggtcatttggtgacaggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggtgagtaaacctgagggctaccagactgtggcttctgagatggatcagtgggcacctcacctcagactagggaaagtttcctttgtgcgaactcttgtatgaactttatatagctccccaagatcttcctacctgaaattgatttctgaagaatagtttaaattctttgcatttgctaaatacagagctatgagtagcttcctggacatttccaaaacaaagcacttttaaagggctctttttttttttgagacaagatctctctctgtcatcacagctcactgcagcctcaacctcccgggctcaagtgattctccctcctcagcctcccgagtagctgggactacaggtgtatgccaccaggcctggctgaattttttttttttttttaagtagagatgaggtcttgctatgttgcccaggctggtctcaaactcctgagctcaagtgatcctcctgcctcggcctcc

SEQ ID NO: 15894 - DNA, 2699 bp, Homo sapiens
actcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagtgtgtgtatgtgtgcacatgtgtgagagtgtgagcgagagtgtgtgtgtgtccatctaagtgtgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctggagcagcggtgtttcaccaccaaatgcctttccaggctgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtat

SEQ ID NO: 15895 - DNA, 1125 bp, Homo sapiens
ggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctct

SEQ ID NO: 15896 - DNA, 1238 bp, Homo sapiens
gtggtggcgggtgcctgtagtcccagctactgggtgaggcaggagaatggcgtgaacccgggaggcagagcttgcagtgagccgagattgcgccactgcactccagcctgggtgacagagtgagactccgtctcaaaaaaaaaaaaaaaaagaaaaaccagtgcaaaacatgtgctgtactaacggcaagtcagaagtgtcatcctcaagtacaaagatgaggacagatacagatgcctgaagggaggatatgagccgtgtcttagaggctcagagtgtgttaacaggagtctgacagtagaacgttggcccctcgatctttagtctgactttaggtatacattatgtatagcatactacaaaatgaatttttacttagtcctagacatatccagatcattgtgggacaaatgatctatcctttgtctctataaaagaacgtaatcactaataataagcttttctacctacagagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtgggattaacagactagaaggaagactaaggacctgaccacccatttcagcatcttcaatgtggagcagtgttctgaggactcttctatcctaggactatgacagtgtgtattaataaaatatttgctaagattctcattgttggagaactgttttcccccttgccctgtgggccggagaaacttcagtggaacattcaacttttgattttcagattggctgcaaagcctaaaatttgtgattccagtcaaggaggtataatctttcctaaaccaaaagcaagatgattttcattatgccaccaggaaatttcctggtgtgttatagtgaatggtcaactgataattttctccttgctttgataataacagaataaaacaatgtaatggggaggaaggcacttcagaagagacccctctccatgtgccattgaatgcatgagtcccccagttgggc

SEQ ID NO: 15897 - DNA, 1181 bp, Homo sapiens
gattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagca

SEQ ID NO: 15898 - DNA, 2672 bp, Homo sapiens
gaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacactaaccattctcctatgtatatactaatttatctgggaatgtaatactttattaaatgaagaaaatgatgctttcttcatttaatattttccacatcctggaaaaactataaactgacacagaataggttgaaatcttaactggggctaaacaaaaccctttccattggcagaatctccttttttcagggccataatgacatgatgtaaaaatttgctttaaaccattcatgcccttaaatagctagattttaaagcataataagcatattaacatttttaagcaaaagatacgttaacagtgacctttggttatccacagtagcaagagtaaagcacagatcattgaaatccatagataatcagtgaatcaactttcctaccaaacaatagattcatttacatttctttttcctccctatcctttcctgtaagcacctgtttttccatggaatggggttaatgagtaggtagaaaaggaaaaggaataatcagtaggagctgacaaccagtgaccatataagcagctgattgcctgtaattagtcaggctgaacaattagagttgaatgctgaaattaggaaccacaggtggtaatcctgagtagatgtagctcttcagcgtcatctcctgccctgagctccaggccatctctctaaccaccaaagaactcttagtacctacgggaaggaaaagctgtgtgcgacacagaggaaactccattatttgaacacatttctttggctcttgacaaatacttgcttttcctctaatcttgcaagagctatggctcttctattttccaatcacacagcttggcatgtaggaaaggttgaatgatcctctaagactgtgttggtcttcgtattctgtaaaacccattttttttttgtggtcttacagatgtttagaaagtggcacaggttactgaattgtctacctgccagcattctgatatagcacaaaaagctattttcctttattttttgtattattttttatttttctggcattgagctctagggtggatgagggtttatggtcctctgatcataagctccattctaaaaactggtcactgttagctgaaattgctttggttccccaaatgccttggaactccagacgcacccgcagggcctgaggtaggcttcatagagttctaggacttccgtgtgcgttgccaccagatcctgcccagcaatggcctttcccttctaaggtcattagattcagccaaaagcgacctcttctctagtccggtgttacgaacagaagttctgagttgtgctacaaaagtagttccatctttttggtgtaattttcatgtttttaattt

SEQ ID NO: 15899 - DNA, 1731 bp, Homo sapiens
tatgtagtaggatttaatgtattactaatacacatatgaaaactcactaaagtatccccagtagttagtaaattcctaattcaaatcaagtaatacagttctctgagaggctagcatctccatatcttccatcttttaaatacaattgatacttttactttaatcttgcttgttaaaattattctgttagctattacctggtgtaatagttcttgtttactgaaaaactgtcaacactccataaatctatttattctaaatttgggttttaggcatagttaagaaagtaattactgttactggaattcacctgataaaccatgtataacataattcattgcagaatcacattaaatatcagttaaacatgtattattcataaagttttttgttattagaaaaagaccttaaatgcttggcaaccaattctaataaaaattttttttctctttataggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaatttttttcagtcttttttttttttagagagggtctctgtcaacgcagactggagtgcagtggcacgatcttagctcactacaacttctgcctcccaggctcaagcaattctcctgcctcagcctcctgagtagctgggattacaggcatgcaccaccacgcccagctaatttttgtatttttagtagagacagggtttcaccatgttggccaggctggtcccgaactcctgacctcaggtgatccacccacctcggcctcccaaagtgctgggattataggtgcgagccactgcgcccagcctcagttattttatttaacagtgtaagtacttagaaagtaagaaaattgctgatttagtttttttttttttttttttaatgtttccccagcattctgcaagttaggccaaagcccacattcaaagaaatgagattaactcttaagtaatgtattaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgttcaaaatatctggagggtgagaagttaccaagtttgtatgttttgtttgactcaccatctttattttctgtatatgtagtagctggcaattgcatatattttcttgattaacatattagagactgcttccatcatcttatgtaa

SEQ ID NO: 15900 - DNA, 1295 bp, Homo sapiens
ctgtgttgttttgtaaatacttcagtcacatctgcccgtgtgcctgtccctgccaccttttcattcactgttcttgacttcatgaaggcttctccgggcagtcttggtgtgagaagctgtttccaagggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctcccccttactagatatttcctggagccagaaaggtatgcatgtgggtgtcttcacaccggggaggagggcctctcatgggaaagccctggccaccacaccggcctgtgccccttgaagcccaccaaagcggccctcacttgtggtcagtatatcagttatgacgcccattgcccagcttcagtccatccatgttagatggacagaaattatggccagttgaaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccaccaaaaaaaaaaaaaaaaaaaaaaaaaaatgcaccacagtatttctagcatgggggctgtgtttgtatgagaaataaacgtaataaatatctcatagagacatatggaaaaataactttcagattcagcccagttctgttttagagtgtgtttattcttctctacttgatttccaaagtgcaacattttccgatgctttagaaatcaaacaaaccagggacattgttcagatgtcaagccatgcccaattttccacaagattcaagaatcttgtataaaattcagc

SEQ ID NO: 15901 - DNA, 1518 bp, Homo sapiens
gaagactcgagcaaaaggatttcttgtggaattctcagaatcccatgtaacaacagatattttctggtataatttgcttaatgatgaaatagttaagaaagatttcatgtccttgtgttggcctcaacttgatgaccagagattagaagacatgcaggcttctttccaggttttggcctggccttgccatattaatgcagctttttctgatgattttccaaacctaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagtaagatcttttgacctttaaagataatgtttggtttgcagctttgaatatcacctcatcatatgaaaaccttcatctcttatatttagattcttaaaatactagggaggtatgttacaggtgctggggaggggaggcagtggaggtgaccccagatagtggcaagaattacgcattgaagagagactttatcaaaacatagcgactttttttttttttgagacagagtcttgctctgtcacccaggctggaatgcaatgggatgatcttggctcactgcaacctccgtctccccggttcaagcgattctcccacatcagcctcccgagtaggtgggattacaggtgcccgccaccacaccaggctaatttttttgtattttaagtagagacagggtttcaccatgttggccaggctggtctcgaacttctggccacaagtgatccacccacctcagccttccaaagtgctaggattacaggcatgagccaccacgcccaggcaaaaatgtagagacttcatcaaaaagtatatctcaggtaaaattgaggagttaagcatcagaccttcagattccttcttggaaagttttcgattccttctgcagcttttgcttctccactctgagagcctctgtggtttgtcttcctaccttagtttcaccgtactgctttctcttttctttccccaaatcactcctcgtctgcatcctctctaccaaggaagtagtggaggacagactaggtttgttggggatgttggagaggaagggaaaaaaaacctatctgggtttcccttcatttctgtccccctccccaccttcaggctgatctcaaggatgaggagtaggccatcgttggcctaaagtagatactgcataggacttcattagcttaaaagtggttgtaggctaggacttcattagcttaaaactgtacttggcagattgtccctggaatcattcttgcagctctgttccttctttcttgctcccttcaggccgactgaaccaagctaactcctccggaagagagtccaaggtgcctggtgcccgaagcgctcagaatctgccagg

SEQ ID NO: 15902 - DNA, 1106 bp, Homo sapiens
catgtttatgttgattaagccctttttatagttgacaggattttgtaatagttttattatgtttttgatgttagattgggtctcctgctgaataaaaagtgctgagcaaacagcataagctaaaggtgttccttgggaatagttgctgtatcttagagaatttctgtgaggccattcatgataaagtacaaagaatttgtagtttatgtgttgtgatcatatgcttttaactgaaaatttacttttcactgaaaaaatttgcatattacagaacaaaaggagaaatggggagatgctgtttaaaaacacctaggtgaaagtaaacaaggtgccttcaagtattttcacatagcatgatttttacaatgttttaatatacagattgaaaggagaaaaggcctgttctcacctaacgcagttaagcttacattttacaaataattgtgtcattttaatgtcaatttggtcacagttgcttgttctttgtatcagattacttagattttaacatcttcgaggttatttttatagggatttggcataattgattgtactttccttcttcctagactctgtgggtgtggttggaagtccagagatagttgtgcttttacacggttttccaacatccagctacgactggtacaaggtaatgaagtcagacttctacgtcctactatgtcttaaaaaatctcggccgggcgcgggggctcaaatcctagcactttgggaggctgaggtgggaggatgacctgaggtcaggagtttgagaccagccaggccaacatggcaaaaccccatctctactaaaagtataaaaattggccaggcatggtggcacaagcctgtaatcccagctacttgggaggctgaggcaggagaatcgcttgaacccgggaggcagaggttgcagtgagctgagattgcaccactgcacttcagcctaggtgacagagcgagagtctgtctcaaaaaaaaatttttttttaataaaaatttaaaaaacctcaaggattttgttgtcagcaccagaaggctcttgcacatttgaattgcttttaaaaaaacattaaatgttgaactgttccttatttactgaagggaat

SEQ ID NO: 15903 - DNA, 1361 bp, Homo sapiens
ttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaagtggactctggcttcccctcccccctcccccccacccctctgggataaaaattttccagcattgccaggagctttcaggtacacattaaagaataaaatgaagttaagcagctggagtataggatagtatttgattttcaagatcacccaaagctgcactatcgtcccaaagctgaccaagtagaataaaaagaaaaaaaaaaaaaaacaacccatgcgcaaagatagacatttgcttgatctgctggctcagggccaaatgtttaatttgcttctccaaagtcattcatcttcaaaagtctgattctgggaaactgatgccactagcctaaaagcccactgaccatgtagtgtgcatcagtt

SEQ ID NO: 15904 - DNA, 1246 bp, Homo sapiens
ttcccctccaagccccagggaagggcctggaaagcgcttacacctcagacccagtgtcggtcagccgtcaaggagcgagcgacgtgggaaaccctgagataggacattggcccggcgctgggctcgggtaacgatgcggggcggggagcgcgggcggccggggagggcggcggcccctttaagagcaggccacgccccctcccctcctcccgttcgctgccagcggtcggtggcggccgctacggtgctgacaagatggcggctggcggagctgtcgctgcggcgcccgagtgccggcttctcccctacgcgctacacaagtggagctccttttcctccacctaccttcccgagtaagtgccgggccttgagctcgtgctgccccacccttccgcgtcagcacggttgggccaggggtgcaatggagggcagccgagccgagaggcccaggcggggcctgctgagggggacgtgcggcctccggagtcttagttcagctgctgagagcgttgctcggcctcgctcgggaaggggttagggtccggagagcgagcccagggagaaggggcgaggtgtgtggcggatccggggcgcgcacaggagaaccggaagcccagcggttctgcgcttgggatttgggggttgaggttgaggagggcttggggggcggacggctctggggcaggaatcggagttggcggggccctgcccgcgggcaaactaccccgaatgtctgaggtcgtccgaggtggtcggcgtcgggggacagttcagtcgattgctgccgggacaaagtgtaaagccgaggagtgtctattccagagtggggtcattaaaagtgattagctctagagtagtgttaaaagtcacggaaggctgaaaagttgtggaatccatctgaatcctagcaggcggggagaacttgtaggattggcagacgttgtctttaatgcctggaagttctgaaaaagatagggagtgggaaggagggacgttaccgaagaatttcagtattacggctcattagaagatgggtttgtatggacacagacacgtttcccagtccggaaactcaaacatagaaacatctggctttaatgaatttgattttcaacaccggctttgtcttgatccctgatttaggtgttaaaaaaattcagttgcattgttaggtttttgttggtggtgtttttttctctagcaaattccttctgaaatgctgaaaatactcttacatagtatctta

SEQ ID NO: 15905 - DNA, 1197 bp, Homo sapiens
ttaaaagtaatcagtgttaatgatattcatttaaaaataccctgcttatttcagtttccaaggtatctgttaagcatctccattagaaaatacacaaatctaagcaagtgtttttatttttatgtctacttgttttggatgaaacacattgggattttctgaagttctgttttataaaatacgtagtatattcactttgtttggtagttggtttagtgctaccttgtagttttaagagaagataggaaatgctcctacccagtctctagcaccacagctgcctgtgaccacctggcattaccattacatttccaagaactccacaactacactatctacctggcagtattgttaattctggattcctaaactgacattttctaaatatccagaacaactcctcatactcagtataacagtgtattttattccaggtctgaaagacatttctgatattttctcataactccagataattatccttgtgtacattttctaggtttgaagaaaaggcccaagtggatccccttagtgctctgaaatatttacaaaatgatctttatataactgtggatcattcagacccagaagagacaaaagaggtaaagaaaggtggtaataaatttcagaaattaagtatttttaaatgtcttcctaacttatatttaatgattttgctcttgagtgtgtaaaggaaaacgaagaaaatatgatgacatcagtaatctttaaaatgtcacagagcaggtgaaataaaaattgaataggcatgttttcgtgtgataagattcaagtcaccaaaaacccttggtccattcagaaaaggattatcaggtataaagttttaacttagttttgtgttttggaaagcaaatagaaatttttactttgtccatagtcccatgattattttacttaaggattacataatggttcaatataaacttttctgtggatagttaagatcccccaagagaggaaagaaaactcccctgttgcttagggagaaaatgaagagaggttggtgggagttagaatccttggtgccttaatatttagttatgtgaatgttgtagcagtattgtttgtctataggctactaatttcattcatcactagttgctaagattgagaaatcagttagccaatcattacttttcagttttttgttacataacattgggatagaaacaactg

SEQ ID NO: 15906 - DNA, 1280 bp, Homo sapiens
gcctgatttgatttctccattataaaatacattgctgctggtctcaactagtttttctgttacatgttttaaacacaatggatgtttctttgtatcttcttcaccaggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagttaaatatatatatatatatattttttcttactttatcttttaagaattaatgagtataaaagaaaaattaggcagtttacccttttcagatttttatttcttttttttttaattgggggaaataagcactattaacagattcagcactacaagtattttgaatgttgttgctgttggtcatttggcctgccttttcccttcctatttcactttgcctcccatcacacaactgcgtgtaaatggtgtcacttgttcacctctttacttcattcttaacaagtgtatagttctctaggacagttgatgtatgttaaggtgatatctgtgtctgtattgacttgtcttgtgttacattaaacagtaggcagaactgaggtctcaagtttgcactcttggccatagaactaaaaatgaaacctgagattgacccaagcacctatctgagattggtatataatatttctataatgatatattttatagtagatattacaatagcatctgactttgagtcacagaaaccttaaactgaggagacaatagttcagaacctttttaagagccattctaaaagtgaccagcaggagggatctagtagtgaataatatcttaatagcaattttaggagaaaatgactctttcgtccagaagagctctgcagaaccagggctcccgtttatcttgtgctatctctgtagtattttcatttgagagaggaggctgagtttccagagctttgctttcatttatttttatacacattgtctctctatatctgcttgtggatattgttattttgaagagaaatggtttgtggt

SEQ ID NO: 15907 - DNA, 1260 bp, Homo sapiens
gaggatcacttgaacccaggagtttggggtgcagtgagctatgattgcgacactgcactccagcctgggcaacagagcaagaccctgtctcaaaaaaaaaaaaaaaaaaagaatgtgaatttagctccaattccaaatgactaactcttaggccagtcatagccaatgaaatcatctgacggtagcttctgtagcccttaacctaaggagtcattagaggttatagtaaattagtttctctagtggtgcagagagaaatgccatcggggaaattatcactgtctttttggctaaagttttatattgtgaactggatcccacttaacagcttaaaaacacaaaaatgaaagggtagtcctagtttatcttcttaattagaatcattatttggaaataagatttgcaatgtgctgtctatccccaaacactgctgagcttgctggaaaacagaatttaacatgaatgttgtctgaaagctgtaggatcaatggcaaaaaaggggaaatgtttggtagggaattggaccagttctaaggtatcacttttaattataaaataatgtcttcctttttatctgcttttcagacagcctcagtgaactattaaacatttgtgtgcaaagtcctattttgcttatctaaggcattttgacttggaagtattaaacttcaggaacgagctagagaagacaatgagggtatgttagagaaggaaaaataggagctttttgcttatggattttagaggtccacaaatcgaaaggaaaaataaatttcttcatttctaaccctaaaataattttgttaatgagatgctgggaagaagactaccaaaaggcctcaaagctcatgcttctagaatattcagtaattctgaatagtctttgggaagtagcatttcttgggaagtagcatttcccttcttccaaataactgtttgagatcttaaaacagaaaatccagtgttaatgggctctagatcttaaactaggtgagcagcttcttacatacaaccagttccttgttaaggatccagcaggaaaaccagccataaaacatttcaacatgcagtttgggggctcccttgcttattcactgagtttaagctcttgctgcaacatagctctgtaccatctgggatgctagcagtcacagcagttagctcagatatctgagctgtctgccacacaaagcctgaggagatcatcattcttcagtttcattcattacttaatgaatgccaaattaattggcaggaaga

SEQ ID NO: 15908 - DNA, 3684 bp, Homo sapiens
aaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcagctctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttcaagctctagtagtttcctcggacttcttaaagccttcacttgtgtatgaggctcatcgccaaagtgcctgagaatgtcggctcacacccgtagcacaggagcctccgtgctgagttacacttgtccaactctgcaggcaaagaaattaggcaagagaaggagagaaaccggaagaaaaaaaaagggggatcctaaaggtggttatgagtctttatgttactcaagctatcctagtgactctaaagaacctcactttcccctaagatgacgttgtatgtttcgctgtcttccttccctctacttctgcctcag

SEQ ID NO: 15909 - DNA, 1183 bp, Homo sapiens
gtctggaaagggaggccacgggaagtagggaagggaggaagaggaaggaaagggtgggagagctgagggttggagaatatcaagaaaaactgagattttacaggttgttactctggggttccaaaagaggtcctcacggaggttccacatcaccagaccctgggtcctgtatcagaactgtcctgggtctgcacgctggagttcactaactggacttccagccactttacttcccatcctcaacgtagaccaggaaaagtcatgatggaaagacttctttgttcctcctcagcccagcagggctctgatcatgccagcttgttgtgttgcaagacacgaaaagaagccagcaacaaaattgtcttgcgtcacttaacttcctctcagatttctaagcaggtaattatttcctctcctccaatggactgcaagcattttggagggtttttatcagagacactccataaataaaagtgtcaggttattaaggataatcttatccactctcctgagcaagttatccagtggaatattgtgctcttcctctgtggcactttcttccttgacttttccatttggcacctaagtgagccaggggaggatgtgtgagcaagggagacatttctgctactggggcctgggaaacaggaccagaggggctttcactccggtctgttctgtgtgacctctgggaggcttgttttctctagttcattccattgctgaacatgagttgagcatgtactgtgtaaaatcccacccagaaatgcacacatttcaaataagatttggctggtttctaccctcaaagacttcttgtccaaaacaagattcacagcacaatttaaaaagcagtttcacattgactttctaaatttaattcacaccacacatagtaaggacacaataaactttattgaattaataaatgaaccatgattccagtgagggaaggaggatgattatttgtactcatgttgtatctatgaacaaactaagactcagatgggctacatgatgctcaaagttagattatagctaacaagtgctggatctcattttcgatcagatattctggttaaaacccaatacaccttggcccacatctcacgcccctcccgagtgaagcacattcaaatgattgacttctgttctggtggccatggagaggaagcagtggtca

SEQ ID NO: 15910 - DNA, 1478 bp, Homo sapiens
ggcctcccaaagtgctaggattacaggcgtgagctactgcgcccggccttgttggggttttcaacccatgtggtggtgagaggggtcatttaaagatcatattgataaagcaatggtgttgattaaaggagcaatattttgagaacaggaagcatatgccttgttttctgtgtttttaaaattagatatttgaaaagcaacacaaatcatactaaatagttagtgccatttattttttgtcctctcccggtggtaaaacttactctttctgtttttcttgcagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaagactggcattgtagctcctcacacattcctttggctgggttagatgtctatgcttacgggaattgagctgatttatattgttaataatttgcatttgtgctgtacctttcctctcaaaggctccagagcatttcgtggagcctccgacaggcaagtgatgcttataacttgcctatcaggtaggtagaattcgggaagatctttacaaattgtgtgaactttcctttctttgggatgacttaagtcatcctgcctggggcaagaactagattagataaccttggttaggaccttctgaccctgcaatactaaaaaacgtttaaagaaaataattcaaccattaggtttttttttcctctttccaatttttcaaaacttcctgattataactctccctttttttt

SEQ ID NO: 15911 - DNA, 1528 bp, Homo sapiens
cttaagtgtttctacgaagtagtctccaagtctcacagggaattctgttttttttgttttcccaactttatttttgtttgttgtataattgacaaatatgtccataatgctttatacctctttatgatagccacattttgtttataatacttgtgattagttatgtgtgtttatcttgtacactcctgaggacacagagctaattttcatatttctgtattttctatttttttcttttgtttttgaggttccataacttgcatatttctgtattttctacaaatagcacagtgaatgaatcctagattttctaagcttatactatgaagttatgtttatgcaattagtgtatagttttaaaatacacacaaatgtttagtatcttcttcactagccatttaaattcataatttaattctatcctgggagaaagtcaagtttaactttgaatattttgttattgtttatagcatccttattaacatgctgatgataacatttactgagcatttacattgtgattggcactttgcatggattgtctcattttatacttaccaacaaccctgtgtggctgtgcgccctattgtttaggtgaaggcttaaagtaattcacctaagaacatacagccaaaatatgatagatctggatttgagccaggttccatgcttaagcatttagctgctgtctagtaccaacttgaagatgttcattctgtatgtaaatcctgctgattgtagcattagttctttgtgtggtaagttagctcttaccagcttctaatacaactttttgggtcctgacgttatgatttgattaatgctacctcataacctaaaagtgttaagcattcaaaaatgcataattttctcccagaatttgacatttcctgggaaaatttgaccaaaaaagaataagtaaggtcttattacctagcgattacagcatgatacccctaagagttattttaatatcgagttgtgcttctttcacgttgaaataagaaatttatagtcattaaagcagcttaaaaatttcttcttgaggtcttcattcacttgctcatactttgattaatactgccttccatcttttcatctctttccatcttctggaaagaaagcaaaccttttttttttttttttttttttttttttttacttttgacaaagtgttctgatagttatttcatcagagtttggatcgttgtgtgttcttcaggaaaatgtgtatttttcaggagtctgttggtcctgtgggagggaagcgaggggtaggaccgtggttatcgtgtcatagagggcagaagccacagtctcccatgggtcttccaggatgaagggccttgtctccccaggacatgttgaagacttgagctctttgataatgtgttttgcatgtataacttctccattatgaatttgaattgatttgctctatggcatccactttgctcttggctttcctaagaatgatggggttttggctcagcatgaagccctcttggcttgaggagctgagggaaat

SEQ ID NO: 15912 - DNA, 1270 bp, Homo sapiens
gctcatttctagtctctcccattctttaccttagtcacttctctgaaagaccaacccatgaccagctgcaaacagagaacatgaaaggaagtccatgcgtaatgaatcagtttcttcagtgacaaatctggggtcccggttgcatgggcaaatagtgaagccagaatagaggtggtagaccaagaaagaaatgtcagtggactgactggcagctgccctaagaacagtacatgtgttgagtggaacaaagggaataagagaggtggaagcaaagtcagtcattgtgaaaggggaataatttcagaattaaagacagtaagttttgagtaactcaactgaaaattaaatttgttgtacgtctaagctgaaggattttttgaggaagctgaaaaaatatcaggtcagtgggttgaaaagtcatttctatgtatattaaagtctccaaatttggaagctaaggatgtagtggaggaggttaatagtgctcatgtttgaggaaggtacgagagcaaaactcttagtttccagcgggcagaagaataccttggttggcatttctctttgcctcccagcttttactcttttgaatcttatctttgaagcactctttctccacctctttttgcctgaatttggacatactgtcttactctcttagtttatggagaccagcaagattcaaaaactcaaaaaactcattaaatatatacacacactcagcaagacataaaaagagatttcacaaaaaaatgtgaaagtatcaaaagatttgttactcaacataactaaaatattaagcaacatgttttgattggaatagcatatctgcagtctgttctgttttacctaataaatcttgtctattgtctgtctttactgctttgtgtagctggtgaagcatgagaaactggcctcgtacattctgatttgtagatctcttatttacagattctggttgtgtggtatagatgacaaattgtagtactcacaactcctgtatttcagcatctgttgtaatatttgccaaatagagccctcaaagcacttagggaataaaagtggaatttatgccataggatgacagctgattgagagagtcccttccttcccagagtgttgtcagacatttgcatggtctgccatggccacagcaacatggctgccagtgacatttagttattgggcagttcccaatttatttaccagatttctccctttattgttgttatttattattatggaagacatacatattcattggatcaagatt

SEQ ID NO: 15913 - DNA, 1706 bp, Homo sapiens
aaaactggagggccttcaaggctctcatcgctgctcagtacagcggggctcagatccgcgtgctctccgcaccaccccacttccattttggccaaaccaaccgcacctctgaatttcttcgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccgggcctttcgcaataccaaccgctggttcctcacctgcattaaccagccccagttccgggctgtcttgggggaactgaaactgtgtgagaagatggcccagtttgatgctaaaaagtttgcagagacccagcctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagagaggagacccagacgctggttcgagagtacttttcctgggagggggccttccagcatgtgggcaaagccttcaatcacggcaagatcttcaagtgaacatctcttgccatcacctagctgcctgcacctgcccttcagggagatgggggtcattaaaggaaactgaacattgaaaaaaaaaaaaaaaaaaaaaagactggatccaattgctgaaaggacttgaaaagaattatagatgcatttttttaaaagtatcatatatgtttagattttactcatccttgttgctttcttaccatttattctagatagtttaatattatatgctttagtgaaagctaacttatttttgctgtttatagagaaattatttcttattataccctcacttccttaatttcaaaaaggaatctctgtgaattattataagttaattcaggatgagtagctttaaatcctttttctttttccttcattataaacatgatatggccttattgaactgtttgttcagtattc

SEQ ID NO: 15914 - DNA, 1259 bp, Homo sapiens
tcctcaaagtcttgtctcacttgtatgtattgttttcccttaatctttttaaaaaatttattataattttaatttatttatcactcttccccctgtgtgtattcatgatgtctttttctccagcgacttaccacttttaactaacaaatacaaacctgaggctaggatccagctcttcagaattctcttgcagcgccacatatggcattttataaacagcgagtgcctaataaatgtcatgagccagtggactcatggcagaagtagtagtctgtggaaaacttcccatggtgatttgtttactaatttttattgcatctgcctcttattactaactgatgggtatgatttgaggaatataaatgttattttgtgacttttggatggttactgtgcaaatataatttaattgaaaaatcctctttaattctttaagagagtaatcaaggcagtgatttcgtttattagactgctctgttttggggtttttgagtggagtctgtatctattattgttattatttaatttttcagtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggtaggtgggagtgtattttgtatttttgacaactctatttattgcacattttctagggtggggcgtaagtaacttaccttctgttgatgttgttttcttgaacttaggatactatagcccatacaggccaggcgcagtggctcacgcctgttatcccagcactttgggaggctgaggcaggcagatcacttgaggtcagaagtttgagaccagcctgtactagtagtgaaaccctgtctctactaaaaatacagaaattagctgggcatggtagtgcatgcctgtaatcccagctgttctggaggctgaggcaggagaactgcttgaacgcaggaggcggaggttgcagtgagccgagattgcaccattgctctccggcctaggtgacagagcgagactccgtcttaaaaaataaaaaggatactatagcccatacaaactttgattggtaaaacagcttgactaggcataattcagctgtc

SEQ ID NO: 15915 - DNA, 1159 bp, Homo sapiens
actccctagtacactagggatcactttacaggtcttgaacctctgtaagccccatttctttatctataatctgtgaatttatctgataaaattttgtgctttaaaagagataatacattttacatggattagcatgttgcctgcatcatagtaagccctcagtaaatgttatggcattgctgctaatgctgctgtagtttggaatatgaggattaaattgtgattaaagaggaatgttgattaactcactcagcacaatatctagcacatagtagatacccaataaaaacgttccttttactcccatgttcaaatgcccaccccgcctcttccccatgaataggaacaagtagatgacttactagctataatgaatcttttcttagatccccaacttggaaaatgaatgaccaggttaatatactcctgaatgttggttttagaattagatttgcatggttttaaaatagtttttcttaattgcacattaaaaatgtgtatattaacattaactgatttatctggttgtacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagtaagtattattctgctgttaataggttttaagaattgttagactgaagtaagatgacttcctactttattaatagccataactttgtctagcttaagttgattgaagtaatttagaggaagtgaatatatgttgagttttatttatttttgttttctgtcaggtgaagtggttgttttgggtacagttactggactacctggaactcctaataaaaatttcttgaacttgtttcaggggagttttatttaaaattaagagaaatgaaactccccaattgtttctggggaattttatatgaaatgaaaggaaatgaaatatattagccttgaaaaggccccaagagccaagaaacaacctttgttaataaagttatgcaaatgtttctagctaagcagtattgggccttatgtggttacttgtttaataaaagaacaatctgggtttttttttatctaattataaccttagttaactcca

SEQ ID NO: 15916 - DNA, 1157 bp, Homo sapiens
aaattgttgctttattagtaatcacagggctaatgcaaagctctgataattaagactttatgtttttctttgagtgccaccatggcagcaaatggtatctgaaactgacagactgtagattaaaactttcagaatgtaaggcctagtctagggaaaatgaagttatgtataggtgacttgttccatttgaattaatcaaagggctgctggtgtagaccagctgtgttctctgatgacaaaaacgaatcttgacattttagataatgaaattcagttcagcacctcttagagatatgtgtgataatatatgtcagtcagaaacagagagaaggggagaagctcaaaccttgtcttattaaaatagacattgtgacaagtggacattgctgaatctctggtttctaggggaaaaaatgtcaagggaaacctctttaaaaaaatgatgggaatggctgttttatggaagctgggtgaaaagatttgacttctgatgcatgacctctttgacagttgcctttgttcatgattcctagtttcctggtttattttattggggtacagggtgaggtctggaagacctggaaaggaaactcacttttttggtttgacagtattaatgcaatcatctagttcataccttgtaagcccacttattatttcctctgcgtgtgttttttctggtttagcggattagctgcactgtctcttcaaaggctatccaatcaaggaggggttattaaaaccagggcgatttatgactgagaattaattagagaagcattttcatgcacaacatccaattttttgattagcaatggagcagggccgcaattaacactcgaggaagcttaaatttccagctttttgattctcaggaaatgagattatcaaaccagggtcagacacttgacagcaaagtgggagtgggggagtgtgaaattatatgtaaaaaaaaagaaaaaagagtcgtttgattttgattctgagattgctattaagacaatgggaaattcagaggagggaaagaacaaaaaatctgaaatggaagaacctgaaaggactgattctttggtggcctatttgctatgcacaatatctgttgtaaatgtttgctggaagtatgttttagaagcacagcaatattgttgtgttccttc

SEQ ID NO: 15917 - DNA, 1079 bp, Homo sapiens
ggtgcattaataaaggaaggaggaggacttacctttgtaaggtctgatccatttgcttttggtataattgaaggatcattgactgggttaacatgcactgagctccagtactatccttgccatttactagtgggtatgtgacactgggcaacttacaatatctcaggcactgattgattctttattgataaggtaggggtagtattatatatcccagtttataggatgattatgagaatcaaataagataatggatatgaagtgttttataaagtgtgatatacatataaagggtattactaatcacagtgtgtctgtaatttacgtcttattttattctgactgccccaactaattcaggccttttgccatctcacacttggattgttcctatcttctgctaaatcaattccgtctcttgcttttataggatgtgttgagtagccctgaaataatgttctaaatatgttactttccttttcaaggctttttgctgtaccacctgtctactcttgtagccattatcttctctttatactccttcctccgatttcattccctgaactccttgctattcctgagctctttatgcttgccacctacgtgcctgtgcatgtgctgttatttctacctaaaatcctttctcccttctaacctcataatgtttctactcaacaaaatctgatttgtctctcaagactcatctcagatatgactttgtcccttaattttttttcctcttttgccaggcctgatgtttcttttatggaaatggaatagataatggtaggaatggggatggcagccggggagagaaagtattaccgaatttgattttctgttgttcccaacaaagtgagaggtgatcctaggttttattttgctgttggagaatttaaaattgtggtaagtttttatcgctcacgtaacatgtcaccagtttctcccgcctccacccatgtctattctttggtgcttacatttgtactttaccgatcaggggattttatgtagatctattcttattttatgtaatatagataataaatttttaatacatcatataatataaattccat

SEQ ID NO: 15918 - DNA, 1133 bp, Homo sapiens
ggcgggcacctgtaatcaatcccagctactctggaggctgaggcaggagaattgcttgaacctgggaggcttccgcctcccaggatccgagatggcgccattactccagcctgggcaataagagcaacactctgtctcaaataaagaaaaaaaaaagtgatgacaaaaacctcaattactttttgcaccaccctaatggagacaaaaggcttataccagctatcatgtcaggaatattctaagaagctaccacgtaacacttctgcttatgtctcacaggacaaaagccttacctaactacaagggagggccagaagtgtagtcttaattctgagaaaaaatcaggggagaataattattggccacagctaacagtttctgctgcaccctcatctaatcacctgagttaattatgttagtgaacagatgatcaattacttagtatttggactttgtttatctccctttgtccttttgaaagctgtgccaatatcagcagaatgatgtctgatgttctagagactgcagaacttattgtatgtggctgtcctgtctggcatagcagccacaagtcacctgaaggtattgagttcttaaaatgtggctaatgcaactgaggaaccaaattttaaatgtaatttaaattaaaaactgacacttgattcagtttttggaaacttttaattgtgtctagaacaactagggtatgtgagtctacttttgcaactgtacattttataaaatctaaatacagatcaggtatttccgatgaacatttaacatctgaattgggttgtactctaagtataaaatgcaaactgggccgggtgtggtgggtcatacctgtaatcccagcactgggaggctgaagcgggtggattacctggggtcaggagtttgtgaccagcctggccaacatggtgaaaccttgtctctactaaaaaatacaaaaaattagctgggcgtggtggcaggcacctgtagtcccagctactctggaggctgaggcaggataattgcttgaacccactaggcacaggttgcagtgagccaagatcgcgccactgcattccagcctgggcgacagagtgagactccatctccaataactaaattaattaattaattaatta

SEQ ID NO: 15919 - DNA, 1199 bp, Homo sapiens
ttttagaaaccaattaaataatattcaaacacagcagtgaataaagaactatgttcgctaaatgcctgtgtttaacatgtgagaagatatgtcccttgaccctgaatcttctaaatatgtacagttttaaaagatagaaatttatagtgaaatgcatttgcgtatatttggggtaagagatggtgttcagaaagagagggaagctagatgggctgaaacatgaaataaattccttcagagtcccttccactcatgtaaagctccttgaagggcgtcaggagacaacattcctgtttctgaggaacacttacaaggactctaaggaatgttgtttcccttattatatttttatatcaaaacattttatttccacagttattttctttacctaatctggcattgtagctgtgatttggcgggggatggggtgttaggaagttcattttcttttcaaaattgaagtttttaatgaacttggtagatttcctgaaggttagttccttcaacttttggtattacaaagtcatgattagttttaatggtgaacattaagattgcaaataactgctgtggcgagggtgtttctttgtgaatttgaagtgtctcgtttaaagattggtgcctacattgctaaggtgcataccaccctcagtagctatattaacttatctcaggttgcagagtctttggggttgtgcttgggttaaaattctagccatgcagctttgtgacagggaaagttctttaatcatttgaacttgtttcctcacttgtacgatggagcaaatacctagctcaccgtgttgttcaagtgtcaactcaaatgatattatgtgaaagattctggcatttcctagctgcctagccagtgtatggtttgtttcaatttgattccatgtgtgactgcatgctcttggcctattgctaacgagcaggcagagaaacagcagcagtacagtctggctagagggcgtctgttgagcctccaaacattgaaggctactttgcctctttgtcaggggcatgagcctccagaaactctttcctagatgcgctaattgtgtttcttcttcctcactgtgtaacatgttatactgggaatctctcctgaatgtttgtttgtgtctctatctctatattttctatgacagtatttgcctgactgaggtaatcccaactggagggctgaggtgacagat

SEQ ID NO: 15920 - DNA, 1127 bp, Homo sapiens
tcccattctttttaatggctgagtgatatttcaatgtgtgcatgtattgtagtttctttatccatttatctgttgacagactcttaggttgattccatatcgtggttattacgaatagtgttgcgataaatatgaacatataggtatctttgatatattgattttttttattatatgtctagcattttttttaataagaaagtagactttgtggatagcaggtttccacatttcactttcacttttcacctctttctcaatagttgaatcccttcccaactagcctcttactcttaagagacttcatattatttaataatgttataattaactaatgacatattatttaagtattggggtaaaaccaaaccatcatcaccttaaataagtctgtattgataattgttgcagtgatatagagatagcaccttttctagtccattatcattgatgttcattgagttgtctcagcaatttacaaatttgaaatggaattccagaggcatctgaattatgcttatcctaacaattatgttgtatgaatcaaatgctattacagtaaaagccaaggggaccatccaaattcatttgttatactgaaacacaactgtatgtggggattgcttgaaataatgttttattatatgaagattaacatataaatatggttcaaatgtttttcatgttttagaggttatttgtactgcttcttaggtcattaaaaaataaaacattttactgatcaaggggcatttaaagcatgacagtgttaaagtatgccccggctggcaaagcggacttcctgtggctaactgaggtgctcattaaacagatcaggtggccgtggctgggtgagggagcagtcatgtactctgtgttttgcagagatgctgttaaagtgtcacaggacctccctttctacgatcatgccaaaccagtttctgttgtcaatgcagagataggctgtagctggaagtcccccagctgaccaccaacagaccacctgacaccaaccaactgaccactgaaccagccaattaagaaagactggtgatttagggcttaaaggtcatccagtcaatactattcctcactcccctgactctcctcctctgtcctacagtttt

SEQ ID NO: 15921 - DNA, 1497 bp, Homo sapiens
ggaaagtgttcacctacccaagccagcccattgtccaggcaacactgggtcagctctggggtcactatcagataatcctgcttcttgcactaccgaggttaagaatttgcaccctagaagacttcaattcaaatccctgcttccccactcactggctatgtaacctgaggcccttaatgtctctaggccttagtattgtaaaatatgaagttgggatagtaatagttcatttttcctgggattgtagtgaggattaaataaaatagccatgtaacacatggtgaatgtttagtaaacattagctgaaaaggaaggatcctctgagaaagcgagtggtgagaacatttttatgggcatagccatgctcagggatagtgggtggacccactttcccagtcttgttagggaaagggctcattctagggagaatagactggatttgtggagggcccttaatgtaagaccaaagagtcctcttccagtccatttggagccattcgtgattttcacgtcgaaccatgtgagatggtttggctgtgtccccacccaaatctcatcttgaattgtaactcccacaattcctatgttttgtgggagggacctagtaggaggtaattgaatcatgggggcaggtctttctcatgctgttctctcagtagtgaataagtgtcacaagatccaatggttttaaaaagagcagtttccctgcacaaactttctctctttgccttctgccatccacgtaagatgtgacttgctcctccttgccttccaccatggttgtgagacctccccagccatgagaaactgtaagtccattaagcctcttttgtaaattgcccagtcttggttatgtctttattagcagcatgaaaacgaactaatacactatgacacatagaagaatttttaggaaaaatagtgtggtggtaggcattccacatagattggaaagtaaacaaattaaaagcaggaagaccttttaggctagaagtaatttattttccaggaagccatggatttgagttttttgaacttcgacttccatctagtctgccatcagccttcattcctttcattaagcccttagttgcagtgtgcctcagacctttgtctgtctgctgctcttcatcattgtgtgcatggtttgaggcttagcattgcaaaaaagagttaagaagtaatcaagattattttaataaggcatagtgacaaaaacaacataaatggcatttctctgaagtgagttttggtgatttctcattaaattgaattggcagaaactcagaaacaatactttctcatttcaagaaatagtaattgtttttaatgtagcgagccagagttctataaaagattgcagtgtcttgttcaacattctgttttctaaccccgtctagcataatgcttgtaagaaactaacttctcaggaaaggatggatggatggatggatggatggatgaattgaaggtatgcaaaggagttcagattcattg

SEQ ID NO: 15922 - DNA, 1260 bp, Homo sapiens
ccacggacaagggttgggggaaagatggtttcggaatgaaatttccaccacaggtcagatattagactctcataaggaacatgcaacctagatccctcacatgcacagctcacggtagggttcatgcttctatgacaatctaatgtgattgctgatctgacaggaggcggagctcaggtggtaatgctcgcccagctggctgctcaccacctgctgtgcggtctggttcctaacaggccacagacccgtactggttcatcgcccggtgtgggggtagggggacccctgatgtaaaggtttcggtgggaaatatgtactcttcggggatgtgctttttaatttcacaataatttgtgttttttgtttttcacattttcccattgtttcttgtagtcttatctccttctggaattaaaaataatttttgtcttctccttttccccccatttttagaagtcatgttttctgtttcatcctatttctattcaattagtggagtaatttagatttttacaagattaaaaattatatagagatgagtattattgatgacctgccctcttcacagaaatagccaacactagatatactcatgtcctcatgtcgtatttatataacattttcctcataaatttaataaccttcttactgtttgtcctccagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacaggtaataatacactttgaacttactatttttatcagcaattttcattgacttggcaagtgtcataaatttaaaaaagaagaattaccatctgtttccatattcatcagggacaaaacaaaagaaaataaataggcactagggaaatttagatttaatgtagttggataatggaagttccttaagatctttaaggaaaattaaaaaaaaaaacggttagctttggatatgagagatggtgaatctcattaacatgcaggcagttcctcattattatgcctggaattggtccttgaaaggaactatttttccattggtgaatgcatccctgagtatgaaggattaacaggaaggaagctatgatgcccaacttcaattac

SEQ ID NO: 15923 - DNA, 1158 bp, Homo sapiens
attgagtaggaccttagagatggtatcttctagccccttcgtttatcaggctggagacttgctctgagagatggagtaactggccacaaatgatccagatagggctagaacccagatttctgaactcgtttttctgggctccctcctggagctctcaacaccccttacagactcatgtcaggagctctcagccttattcacattctccctgggaagagtgatgccctagggcaacgataggcaacccaggaagatgattactagaatcctctggaggaggagggtcattttgtggtgtgtttctgatacaatcctaagagtatcatgttaaccccattaaccataatatccaccttctctaatactagagtaacattgctgtggacacatctttacaaacaaaaattactatgtgatgataattatgacttctgttcacatactcaagtccttgttgctaagtaaatgcagaaagattattagttttattagcctttgatattgaaattgtcatgttctctcttagctatgaagacctgctctgcccacatcaacttggttattttttcgtaaggaaattaaagtagaaattataacacaattactatcaaaattctactaaactataagtcgaaacaaaatataagaaccgcaattatgtgagaataacatgtgggaaactgttcctgctgctgagatgcgtaaagtgaagtctttggaagaaggcatggagttactaggtagccgcagtgtggagggtggctggacttctctgtcgctagcaatgggcatggtgccattgccaatgcttggaagatgagtgtcttcacctaacttgttaagtgccaactagtcttctgcctccaatgaagatttctcctttgtgtgcacaggttcttctactgagccccaggagtttagggtcatcatgtgcccttaaagtgtggagtgataagagagaatctctatacctctgaccaatttggaggaaagcagagatttagtgttggggccacttacacgtaatcttctttttctcactttttcgctgagaggaatgtggtctaatctagacacctactggctgccttgaaagagcattctcagctatactggcagatctagcaaagagatgtgaaaggatcctcaggtggcccc

SEQ ID NO: 15924 - DNA, 1043 bp, Homo sapiens
gctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccctgggacagttttgtatgctgtatcttgtacacaggttgtaggttggtttattgccattttgttttatttctgctgtataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttac

SEQ ID NO: 15925 - DNA, 1192 bp, Homo sapiens
tgacagataaatggtgttagaagatcaaacctctaatcttaaaactgattatgagagtgcagtcatgatttgcaaaagctgaagactttttattacagattgtaaccttagaaattcattattgcaaacaacactaaaattcaaaataattcttgaaaattccatttgcattacaatctagccatgtgaccttgggcaagttacagagttctaatgtataaaatggaggtaataatagtacctacctcagtatttttatggggattaaatgagttaatatactgaaaaccacccagaacaatatctagcacacagtaaatgcttctatgagtagtgtttgttcgtattaacatgaaagcagcaaaaaaatgtttgcattttcctgttcattgaaagaggatgatactgttcaaactgggtggaaatatttggtaaatgagatggtctttgtgaaaatccttttttaaaaatttgataaccttgatttaattaggtaacttaaaattagaataatattggaaagaaattgcagttgagcaaaatattacaaaaatcaagaggttcttctatgggcattcataggaggcattgcagtttggagaagtgagtagggaaacatcaattctgagattattatgaatttccatgtgatacacacataaaagacctgtagtaacatctggcacatagtacatgctcaataaatgctatctgttatttttactatgatttcattattgataaaatcaagatcatttatattctgggtttcagattggttagataggaaatgctgtcaagtcacttgtccagatagtagatattttcttttctttttgtggctcaattgagacaaagaccagcttctacaattaccagatctatataccctcagtgtcctaggataaaaatagaaaagcaaagtgaagaaagacagagaatgtttttgctggagaaagtgaccaatgaagtaacatctttgaaaaggttattcttgaaggataagcccttagcaagcaaagatcatgcttagggtgtgggattgggtggcaatcccatcagaaatacagttatttgaacatgttagttgaaggaaaggaaatctttagcgtatattgaagcttcctgccaatcattgctacctcttttctttcccaaaatctgctatattaatacagatcatatatagcaa

SEQ ID NO: 15926 - DNA, 1142 bp, Homo sapiens
gggttggggtttctggctgctgtgagtggtggccatgatggtgtgacctggactgtctttctatcctcagggccaagcccgaggacccttctctcctggaggatcccaggatcaaggcgatcgcagccaagcacaataaaactacagcccaggtacagccacttcaggtgttgctgaccgtccacaactgcctgcattcctgacagtcctgttagccaagaggaggaagtgactgagcctgttacaccctcacaggaagtatggttaggggtcctcaagtacagagtggaaagggcacagatcggggttttagaagactctggcatgggctcttagattaatagtgcctgcccccactactgcaagggtgactgccacgagggccagcgcttgttcattcatgtggaacctcatctgtacaaatgtaagagctcttagccgtgcagggaatgttctttctcctgagtggtagtgtgcatttctagccagtggagggcctcatgtggtctcatgatatgcctgagacactgaagcgtgtggcacagtggctagcgcaggactctggagtcagatctggacctgaatgcgtcgcctacctgttgctagctgtgacctgacatcttggagcccctctctgatcacctgtggagttctagcacgtccttctgcaggttgtgtgtgtgagagactgagatgatgggtgcgagtgcctggcatgtatacacactcactgtctccttgggctcacaggtcctgatccggttccccatgcagaggaacttggtggtgatccccaagtctgtgacaccagaacgcattgctgagaactttaaggtaagatcttggctggtcaggcctggccctcctccatggagtgggggatgggggaggcctctcatcctgtctctggagtgtcatctgtgggatcaccaccatcctctcttctgaggccagggagctgtggcgagcaagccaagactgagactgacacctcaccagtggagccgtgtgcaggggcaggccttgggcctccagggccccgtgctgtgcacgcatacacctacacctttgctcaggcccttcagccacaccgagaggttacccggggagaatctcgctcttgagcttcactgcctggacct

SEQ ID NO: 15927 - DNA, 1176 bp, Homo sapiens
gggagaatcacttgaatctgggaggcagaggttgcagtgagctgagatcacaccactgcactccagcctgggtgacagagcaagattccatctcaaaaaaataaaaagtaaaataaaagatcatatttgaatggaatgccgataataatcctccctttcataaatatttattcctgccatactattattcatttttcttctgactataaaaaccatctgcctgaaacactgcaggctgtcagtttcacactacaggctgtcaatttcaagttctcttctcttggcaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatg

SEQ ID NO: 15928 - DNA, 1192 bp, Homo sapiens
cttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaacctgtatttcaggttgagtcttggtttcactctttaaagaagaaaagcattttcatatttttaaattacctaataaaatatagaaaattggtcttatgttgacaactgacctaacacgtatggaaaaggttgaagagggattttgcaaatccttcctaaaagaaactatcgtccaggcacagtggctcacgcctctaatcccagcactttgggaagcaggaggattgcttgagcccaggagttcaagaccagcctgggcaacatagcaagacccctttctgtacaaaaaaaattaaaa

SEQ ID NO: 15929 - DNA, 1352 bp, Homo sapiens
caccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatggtgacacttgggttgtccttgtttttgtttttctgttttgttggatgtgagtttgaaaggttttgtgacaagtagccatcagatgttt

SEQ ID NO: 15930 - DNA, 1101 bp, Homo sapiens
ggacagcactccacaacagagaattatgtagttcaaactgtcagtggtgatgaggttgataaaccctgctgtatgtgtttcaaagaatggaattgccagaagccctcgcagccaagacaaatttgggtcattgggagggaatagggaatcaaggaggtgacttcaggtatggccggactgagatgagctattttgatgggattaggattaagctgatttcctttctctcaccttttctttgtgccagcacttggcatagcaatagtggaaaaaacagtgaaataaacttcttttcttctaagctagatggaatatgatcctattccaagagctaaaagcatcattctacttccctgtaacacttgcagctttactgtaagccacatccatgctgtcaggctcccaaaatgtcaaggcacatgattttttggggggaggaggggtgtcaagattgttgcattataaactagctaatttatttcccaaggtatcctgtaatcatagtgcacctgggaggatctaaatttctcactgtttctgcatcatgcgccatatgtgaatttctttggctaacatacccttgcttgatttgattagtctacaattacaggaacaaatgtcccttaaaacaaacttttttttagagtagttttaggttcacagcaaaactgagtgggaagtacggagaattgtcatataacccctctgcctttattgtcttttgactttattactaattttcaaataagatttatgtaaatgcaagtgttattctgttaatgcaaaattaaatgttcctcaatttcattgctcactaaatggtaaagcaaaagttaggagcagattgttctgagttatgggatattctctctctccctattcagtagaagagggaggatcatttgcatggacttcttagggacattagccactcggtgtaagatcatttatcttcctgaaaatgttcccatgtagttatacatcatctttttatttctgggggattttatttttcttataggaagttttccctgtttggcttttgcctaattggaagctattttaagttattcagcatgacagttggactgctttaaaagt

SEQ ID NO: 15931 - DNA, 1196 bp, Homo sapiens
atttatttattattgcatagtcaaaatgtcatgttttagcatcttctgtggcctgtgaatcactgctctctataaccatgggaccactcccacccatccttttcccgatctttttttggatagttgttttcttaaaaaatctggaagcaggctgggtgcggtggctcacgcctgtaatcccagcactttgggaggctgaggctggtggatcacgaggtcaggcattcaagaccagcctgaccaacatggtaaaaccctgtctctactaaaaatacaaaaattagccgggtgtgatggtgtgtgcctgtaatcccagctatttgggaaactgagataggagaatcgcttgaacttgggaggcagaggttgcagtgagccgaggtcgcaccattgccctccaggctgagcgacgcagcgagactccgtctccaaaaaaaaaaaaaaaaaacatggtagcaaacgttcagggttatatgtttgggaaacatacagtacctactgaagttcaggttcaggcattgtctactacatagaaatgattaaatcgaggtccttttcctagaggagctcaaagtctagttgtaaaaagtgaacatgtaaacaaatgattgcaatacactgtggtatttgcaaaatagcgaggatgcctgccatctaagaactcaagtataattattcccattccctgcttttgtaaatcctaaaattatgtcacgtcctcctagggtttctgttatttttgcagtagccaaccagttcttcgttggtcagaattaagtccagaataaaagttttcttccttattttcaccttggaaaagagagatcgtcagcaaggaatgttttatcaggtttattttcttctagcagatttagacttcagagatgttagggtggttgacaccttccatgtctctgcaattttgtcatttgttttggggaagtcatattgggtgaatattctggtgatctgtgtattgtctccttattttacattcccttgaccatctttggatctcctcacagggctttgttcatggtcactgctcagttttgtgctcacttaaatgcttccctccaggctgctgctttgacattgtaaagatcttttatatgaatcttttttgtcccttgccctcatttagcgttgcttacatattgtggttcgggtctcatctgatccagtctgtgatgctt

SEQ ID NO: 15932 - DNA, 1121 bp, Homo sapiens
aaatatcgcatttttacatatatcttattttgtgaaaatagtaccattattttcttcagaaataggtagtccttaaatatatggacattgattccagtttcagtgaagagtcccactaagcaaagctttactgttagtggaaggaggatggcataattagaaaaaggaatttgccttcttatgtgtctaaccactcataacatggaacagatttttttgtctatctcctctccttatatctagggaagatttgggtgtccaagttttggaaaccatagacagatgtttcctttagttcttccaaatgagcctcatctataataaatcctgctaataagagtttagttctctagtatttgcagccatactttttgttttgtcatgtttgtgcctcattttaggtgacttgaaaacactaaacatggagattctcattgtgttgtcagttcacattgagtcttcttttcctttacccctcttcctcctgcaggcatctctaggtacaacaaaatactgcagttacttcttaaagaatatgcagtgtccaaaacctgactgcatgtatcttcatgaattgggggatgaggcggccagcttcacaaaagaggaaatgcaggtagtaaagtcatgtgaattatcaactttgcagaaaagggagtacttttttttttattagttaacattgcaaaagcaaaaactaaggatttgattttgtaaaaactgatattactttaaagtagcatttgccaaatgaagtgtttaatggaaggtcagttctgcaggatattgttacaataaaaatgtgtctgtggtcaactaagtttgaaatgctagattaatgaagatgaacaggtttctttgctttaagacttttcagagtccttaatatgctaatacagatccacgaagggaatttacaaccagaacttagttgaccaggaaaacactttgggaaatgctattttaaggggaatgtcaacaaaatgaaagctaagtgggatattgtaattatttgttaaaccaatctatactctttacagagcttgctagaaaataatactctgtcaaatgatgctgataaactaatattatttttacaaaattattctccccatgcaagt

SEQ ID NO: 15933 - DNA, 1174 bp, Homo sapiens
ttaaagcatatattatacatgttcatgattgcacatgcctaatttacttaattgcttgtttctttaccattcatttacattttcaaactttttattaaaacattctgagacagtgactgtcatttcagtaatgtaatctttgatctgtgttttctgtgaagtaaataaaatttttgtgatctttagatagcatgatttctattttagaatttatgtgcagaaaaaatgagtgtctaacttttttcttgtttatttgtagtacacttataaaaatgactgaaaatagtgaaattgaaatttaggattattgtcattttctttttttgtttttagtatgtgtacaatcaacagtagtgtaccttttgggatgtagaaattaatgttaattggtcattattcttctgtgagaatgctcagattttctgacttttggatattattcctgtgtatcagaagtgagaatttatctggtgatcggtaaagtggtctatttttgtgttttcagatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacaggtgaattgattgtaggtaattttgttatgagaaacagcatgttagcacttaatgacatttttggaaggagtattatctttgacatacataagcataagcataggaagatatccagagttgtattaaatgaaacctttagtgtagtagtgaaatacagacttttttctccttgtctctcaaaaatatcatatgaaatactatttcccattcttggagccactgacaatgctcttttaccttcagggtatgagtttaaaatttggaatgacagtgtcacattaattttttttttttttgagatggagttttgctcttgttgcccaggctggagtgcaatggcacagtctcggctcactgcaacctctgccccccgggttcaagcgattctcctgcctcagcctcccaagtagctgggattacaggcatgcgccaccacacctggctaattgtgtatttttagtagaaatggggtttctccatgttggtcaggctggtcttgaactc

SEQ ID NO: 15934 - DNA, 1099 bp, Homo sapiens
aggtttttgatgtgctgatttttgggttgattttggtataaattgttattactgatttaacatcctcctagattattaaaggcaaaatcagctcagaaatagaaaatgggtgataagtaatacatttctaaagagagaagatgaaaattttattttatgttttagttaagatctcgtaacattgactatataatgaagaggtcagtaaacagcaatttcgtgattttttttttttttttaactagcttgatgctttgggaaggaaaattaggaagcaagttttgaaatcaatgaatttataaaacttttgtttctttaattatgtgtatagagagctaacttacggcaacttaaggaactgagttttctattaaaaatgtaactaaaacgtaaatacctaagcaggtttgcctatttttccttatggatgaatatttacatatatcaatcatagtttttctaatatttagaaacctgtaataatttgtcattttttaccttcatgttacttcagagtataagtcagaaactaatggctggatttgtggagtgtttggattgtgaagatgcagaagaatttgtacgtctggaagagggtatgccttagattaatgtgcatacacgcattcttttactttttatatatgcttaatttaaagaaaacacttgtaattgttaactgttttagtgatggtgtaagaggaattgagaatttgctagaatacaggttgagaatgcaaaatccaaaataaaatctgaaaccttttgaccaccaccaacatgactctcaaaggaaatgctcattggttcattttggattttggatttttggatttttggattatacatcaacctgtataatgcaaatattctaaaattcaaaaaaatctgaaatctgaagcacttctagtcccacacatttcagataaagagtactcaacttgtaaatttataaggtttttaggattccactttaaataaatctgaaatgaatgtgatagataatcaggcaaacgatctaaagaaaacatggagttggaatacaagttttgtattttttatttgacttacgttaactttccactgttttgtaattttg

SEQ ID NO: 15935 - DNA, 1181 bp, Homo sapiens
tgcagtgattcatgcctgcaatcccagaactttgagaggccaaggtgggaggatcactggagcccaggagtttgagaccaacctgggcaacatagtgagattccatctctacgagcatgatggtgtgcacctgtagtcacagttgcgggaggctgaggtgggaagacctcctgagcccaggaggtcaaggctgaagtgagctgagattatgctactgcactccagcctcggtgacagagcgagaccctgtcttcaaaaaaaaaaagctatgaaatttgttaatgattatagctgaaagcaggattctcactctaatttgcccttgtcctttaagatactggatgatgaagctgcgcaagagttaatgcctgtggtcgccggggcagtgttcacactgactgctcacctaagccaggccgtcctcactgaacagaaggaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtttttttcatttaaattgtctataaattctatcttttgtatttgttttaactttaattgagaaaagattttcatttgacatcttcctaatctccctaggtggtggattccaacgagtgaggactcacttgtatggctctctgctttattacttacagattgcccagagacctgatgaaccagacaccttagaagcaggtagaatgagatcaattcctaatcttttctggattgggagatggttactttaaattgaaaaaaaaaatcacttctccatcttttgactaatcacaactgtaaaaaatgagtgttagtgtcatttttaaagcatttactcaaaagttgaggaagaatgtttagtttttaagaattatgaagtagtacatgagtactacttttaagataaccttcaaataatactttagctttatatacttctgtaactccctcacttgcctcaagtccgactgaacagtgtgctctacatagaatggtccaatgtctttctttcctttgtgctacatcagagtacttatctagttgattcttttaaaatatctcggcctggcatggtggctc

SEQ ID NO: 15936 - DNA, 1039 bp, Homo sapiens
ggaggctgaggcaggagaatcgcttgaacctgggaggtggaggctgcagtgagccaagatcatgccactgcactccagcctggagacagagccaggctctgtctcaaaaaaaaaaagaaggaaaaaaaaaaagactgatgagcaggataaatacaggacgttggttctcatggagtcttgtaattcattttgatctctttcagaatgatttatccttttccaggtacaattattatcttagtgttatgaaacatgcatgaaataggtgcattgtgttattagagttaacctgcttggacccaccggtcagtgggcctttgtgtacaagcagtgatggaaggatttttttgttgcgttttttttttttcttccttagctcatacctagcatgtgaggtataattactcagttattacactgctttttactggagtgtttttttctgttttaatccttttagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaagggtaaagcaactcttatttagtattataattgaataagtattttgacttattaaggtataaactgattcacggctgggtgtggtgcctcatgcctgtaatctcagtgctttcgaaggccaaggtgggtggatttcttgagtataggagtttgagactagcctgggcaacatggtgaaaccccgtctctacaaaaaatacaaaaaattagccagccatggtggcatgcacctgtagtcccagttacttgggaggctgaggtgggaaaattgcatgagcccaggaggcagaggttgcttgcggtgagctgtgatcgaggcacttcactccagcctgggctgcagagtgagaccctgctgcaaaaaataaaataaaataaattgattcaacttttaataatgtatggtacatattaagaatcattttttataat

SEQ ID NO: 15937 - DNA, 1217 bp, Homo sapiens
gctcccggcctaatttttttaatggccaggcttgtctcggattcctgacaagtgctccacctgcctctgcctccctaagtgttgggatacaggggtgagccactgtgcccaacctagttattatttttctgtgttttctgtaatgagcattataaaacttcacagtgagaaaaaacagctgttaaaaaaatttcttttctctaacaagcaatgttagagtctactaaaatacatctaatgccactagtttaacgtgttaggttttgttttggaaatacatctttacctgagagctttcctttattgataaattgaggttctggagccatagtttttaacttctcaaaaaaaaataaaaaggaaattttgttgcaagtaacattctctttatgaaaaacattcttcatatttcatatctgatgtcagataaattcagttactgttgttgattttggtagcatctacatgttttggactttaatttattcttccttcagatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggtaaggctttctagacatttgatgttagatcaagaagtcgttttctcttggctatagatgtattaaagaaaattaatgtggcatacattctgaatatttctatcataagctggaatccttttttaaggagttttaaactttggaatcttcctagtgtgcaaaagatgagtgaaatgatcctcaaagggatagctggataatgggactgctgcttccctcactcactcaggttgctcatgatggcaatatgacagccagtgctccgtgaggacagagcaaaattgtcctctcacaatacaatttagactatagtagttgcctattgaaaatttccatgtagatatgctagttctattctaaacacagcattttcaatatagtatataattcattgtttctttgcctgcaaatctgttttaatttctttttcctcctagttaaaaggatcacaaatgttacgataatagaagcactgaaattttagattcttcatttactcctttttcctccttcatttatttaacaggt

SEQ ID NO: 15938 - DNA, 1180 bp, Homo sapiens
ggggagaatgacatgttatggtcactggcaggctcattagaaatcaggagaggctatggcactattagaggtgggtcatttcgatttaggaattttgtaacgggtccaaactaagaagttgaatggaaatgtttttgttttctttgtaaattgtactttgcctaggggaaaagcaaaagcaaattatgtatatttagaggtgttaaaaagaaatgcattttattcttactgtttcatattctaaaaactcctttatgagaaagtaatttagaaaattacttttatcattataaaaaaattagatttttcttgaaaactaaaaatgccttttaagatcatttcactctgcattttagattggctttgaatgcgcatgtaccggtgctgttattaatatataacaggtacttacagtctttgtaaaatcatagttctcaaaacttttttatggcaagaatatctgttcatgcacataaacaatataaaatattagaacctctcttcctagtttttaatgtttttgtttattataataatatgttttaaagcattctacattttataggaatattaagtgaacttgacgttgatgtaaatgaagggtctctaatggagctacagggacatattggaagattccaggtaactgattcttatttctttaaatagcagttataagacatgttacaaaatataccatcctccccattgtgccccctagatttgggaaacccctttcaactgttttggttctttagtttttctaaataatatgcttatattgctgcttcttgattttctaattttagtaatcatctgttgactttccattgttgggggatggggaggagatgagaatttagatgtttttactccttttcttccatcatacaatgtatacatttcccataacaccccctgaaactcaatataattacatcatagttttggttacattaatatttagtgttacattattatgactgtgtaaatgtcatttgtgaataagccacgagcagactgtttgccctagagttttcttttttatttgcttggtttttatgtacttattactaatttatccccagattctttacaagctctgtaatctcctctcaatatgttctaacatattagtttgtcaattagatattttatcagtctttctgggagcctcttg

SEQ ID NO: 15939 - DNA, 1122 bp, Homo sapiens
aggcaaagcaggaattagtcacttggtgttaagaaaccccacaattgtgtatattgtttttgatgtggaggggtgtgtgtgtgtgtgtgtgtgtgtgtgtgtgtgtgtgtaaggtttatactttgatagagttctcaaaggactctttgcctaataaagggtaggctctgccaatgtgcatcagtcagatttctttattctcgcaggatttccagccttatgtatgtacctgattacagtggctcctaaccatttgttctttaaattataaatggcatttaaaagtaatcttgggttggttttaatgacaggttacatgtccttaaattctggggcatcccttgttttaaaacaggtcatttgaaattcatatgaaatgcttataagtggaacattgttttatgtcatcacctctattagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagaggtacgaatcttataatgagctggggggacttgagaaatcattgctgttactaggccagggtactcagactgagtaaagacaacgtatacagtatgactgaaggaattggaatgattcttctgtgtgatttgaagaagactccttcgccgtagcaccagccttataagcatagaaactcttgactgaaaaacagtgaagtgtagcacctgttcaagaaaatagaaaggcagctggcctttgaatgaagagttttgggtcatttatactctaaaatctgttctgagaaaggcttctgttacagattttttttttaatagaacttgggtaaatgtctctgtgccttcagcatcttcaatatctgtttagcaaatctttcaaacaaatgggatagcatatgagacttgactgccttccctcagtgacccagaagcattccctctacttacagtattaataactaaagatgctgcattaccaggattgctactaagtagcttgctgccttttccatttggcacagctgaatgtaaggcat

SEQ ID NO: 15940 - DNA, 1377 bp, Homo sapiens
aagtaaaaagtaaaagcttctttcccacctaccctcctgtcctccctccctcccttccttccctgcattctccttccctccctcccccgccagtcttactgacttcttgtatggcccttcaggaaatgtttttgtgtgtatgttagtatatcagcatcagcatcaacattcattgctatttaaagcaggtttttaaatttatacaagaaaagaaagcaggaaaaacatgagaattaaaccaaaaaattctaaggtagaaaatgtgaatgtttagttaatttagtaacacattacaaaaattcaaaagtatttacattgaaagaaccacattacaaaaattctaaagtgttttaaattggaagacttagaataaaagaaatatttgagacaacaattttaacaaaatgtcttttgtgtcaccgctagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaacaaaacaaatgtatggttaatcttttgatcttttatcttttgatcagcattatcaggaatctaacaaataaacctacaacagtggtgattttcccatagagatattattctgaatgccagattaaaggcatagtctgaaaattctaattttttcaccctttgtagctacattacactattaacaatattcagggttactaaaatatagccatgctcttatagaatagtgtactcaatactgtgaaaatgtctgaaaaagtcaagctttttcctaaaattatttaggttttccttttttttgtttttttcttttctgcacgtaagttgacaatacaattgtcccttggtatctggtgattactggttctagggctcccacggataccaaaacctatgttttggcatgcatgttccttatataaaatggcattgtgtttgcatataatatagatacatcttcttgtatactttaaatcatttctagattacttacaatacctaatataatatgaattctatataaatagtggttaatactacgtttttaaatttgtattattttttgctgttacactggttttttcccccccaaatatttgtgatctg

SEQ ID NO: 15941 - DNA, 1174 bp, Homo sapiens
ctccagcctgagtgacagagtgaaaccctatcttaaaaaagaaagcaaaaagaaataaccactatttagcagatctcttttggaggaagataaaagcttgtaaaaccatttatctttggaggaagagaagtacaagaatattgattaggtagatgcaaaattataataaccttttttctcttcaaagataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagttttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgtatagtaaaatcagcagctcaagaagaatttctgcttctctttgtagttgatgct

SEQ ID NO: 15942 - DNA, 1641 bp, Homo sapiens
attgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaa

SEQ ID NO: 15943 - DNA, 1641 bp, Homo sapiens; identical to SEQ ID NO: 15942

SEQ ID NO: 15944 - DNA, 1182 bp, Homo sapiens
aaaggagctctacccaaacagaaggacaggaaagagaaaaatgactgttctttgtacagtgcatcatgttgtagtctttatgaagaaaaatttagaatatggtttatatattctgcctcaaaaggcacataagttcataatatattttaagaggatcttttaaaaatcaatatagttcagttaaaatcagttttagaacttacagcactcgactccatatattatcatctgcggaacgttgcacttcagtttttccatatgaatgatgttagtgcatttacatgacgttccagaaggctgagagatagcatatcttaatgcaccagttctcaaattcttctagcccagatcccttgtgcaaaagatgttttgactcagaatcctgatttgtaaaacaaaggaggaggcattgcatttcattgaatgcatgaggcttcctgagttttctccgcatcttccttccatcttcagtgactttcgtaacagactaagaaatccctggaactccatagaacttaatgcagagcgtagtgtcaagcacgaagctagactaggacaggagttattggcaaggagggaggcttttcaggcatccttaaatcacagcctgtaagtggttgcctacctgtggtaatattgcattgcttatccacaatgtaatttactaggagtttcatgggaaatgaatagactaaaatcaactccagtttcctttgtgtcgctataactctgattagcaatgtgactcaaatgccccatgcattttccacaggtggtgccaaagcagtgattcgcaccaggatatccataggaaacagaagggaaaccatgatttgcttatgggtgctctaccctgtagagcaaaatagaattttttgattgtccttttgattgctactgctgtgttactacgattactactgtatgttttcttgttcctccccctccttctttttctcttcttcttttcttttttagtagtagaacaagacactgttcagtagtgtagctagatgctttggtttcttttatcattgttatgtgcaaaagcaattgtcaaatgtatttcatgtgctacaccatgttcttccctcaggaagaggaaatccgagagtgataaaagcatctgcaagcagaataaaggaatctcagtcagtggatttcttctacaagtttcatggc

SEQ ID NO: 15945 - DNA, 1218 bp, Homo sapiens
agtaactacacacatcttgtgtgcacatgcaccgacatacatattatcacctgaaaatataaacccagatgcaaacacaggtgagcactaaattaattctaaaattcatttgaggatttggcaccatgaagttgcatagccacataccctcaggtagacaagacaggggaatggcagaggtaccttggtagaaagtgaaggagaagaagaaaggttggtggtccagagaagtcagtatttccttgcctggaatgagtgcctgcctatcgaattttgataaaacttcttgattgtcatccttgtttcattacggtcctcccaggaatattttgcttttttctaagctttaaagatcatagcttcgtgacttaatctttggactggatttccccacttatatgagaagaactaataatgccacatggagcacaccttttcaggactcaaggagtctaaaaaaaagaaaagaaaaatgagtcagaacttctgcctgtgagtctgagtcagcttagtgtgttaaaaaaaataataataaaaaaagaaaagaaaaaaaaaaccgtgtgaggagacctgcctggaaaaactgctgaatggaaagacttgagaacagcttatagatattgacggcagatgaagaattttcatgtcttttcagaaatggttagcagccactcataacagtcctgtgacgtcacagaaatcttgactcctgcttgtctttctcgttctcctttaagcccttccctcctccttttcatataggaccttaacacaagagggtcaggaagagaagagaagggttgctcacaggaggaaagaaggcaaggggtagctgttactttacctggtgggccatgtgtcgctacaaatcaggtggtctctttggaggagatgccacttggtaagggaggcttcctgagcactcgaatactactagcaactcagaatgtgggaccgctggaaggaaaaacacccctggatggggcgaaggttgagttcaattttattttttactctgtgtgtgtgtagggggagggtaatgggaaatgtgtgttttgcagacacattaacataaggagaatagcggatgcgactttattatcctcattcacgtaaaggtggacatttaaatttttttttacagtagggaaaaagaaccttctgagttgatttggtatagtggaaattgcatggaaatgtttagcttcctctgttttc

SEQ ID NO: 15946 - DNA, 1306 bp, Homo sapiens
ctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagc

SEQ ID NO: 15947 - DNA, 1151 bp, Homo sapiens
ctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggca

SEQ ID NO: 15948 - DNA, 1140 bp, Homo sapiens
tttattatgtctttttgccaggcatcgaactgtatcttttacaagtatttcaagtaaattctcataccctatggggatgatgatcatcatcatgaccaagatggttaagagccattgggttgatctctcagttcttggaaggccatacttttgaaaatttaattttataaacttaagagtaacaagaatagtacaaagagcttttctagttcctgaatcctttggaggaaaaaaattcaattatgccctagatatgtgagccctagattaaatttgtttaggtgtttcttttttttcaatatatgtatctcacaccttcttaactagattttgatgtttgttaggcccttgcattatatttctgctgtttcctctcagcatggtgcagtatacctagtggtatgtggtaaatgctcagtgattaaaattcatgccaaatgaacaattctgtatcatagatgtcatggaggaggtgggaaagggaaatagtgaagagaggaaatgatgcattaggaattcaaaagtacattgtcccctaacagtggagagtggatttgcactttctgccgagacttatctaaaccagaagttgaatatgattgtgatgctcccagtcacaactcagaaaaaaagaaaactgaaggccttgttaagttaacacctatagataaaagggtaagtctttggtaagatgcattattgtattgtagtgcaatattgtactgtggtaccttttgtcaaagaggtgtatatccatccagattttatactgatcctttttatttaagagtatttttttttgtttacaaaggtacatgaatcttaaagactgtaactttctttaaattaaaaaaatcacagaattaatgcatgtattttatagaagcttattgtacctgaacaagatggaatatgtaccctagacttttaatctaccttaagtaaatttctattttgttttatttcctactatagataagatttttccttagaactgccaccaaggagctgggttttttctttactcttcctggaaataattccttttttttcactgaatgggactagacttatgcatcaaagccaactgatatatttaactgtaaataacatttaaagctaccaagtcaacactttgtt

SEQ ID NO: 15949 - DNA, 1207 bp, Homo sapiens
caaaacagctcattaatatatataatctcagaagtcaaaagtgtgtcctttttttactcatttttatttttactccacagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaacaaatgtttgatttttgtttttgtttttatcttgtctgtagaggtattttggtatagcaggttttcaaggccattttttatacatttctagatctagattttcaacttcttccactgagggaagtatatacatttgggtttgctgtgtgtctatgtgaggtttaattgtacaggtgatccttttacaacaagcctcattgtttgcagtatagcttttagtggaactacccaaaatataaatacagcagcgtgcactgtatttgatgtgagggttcttcatcata

SEQ ID NO: 15950 - DNA, 1144 bp, Homo sapiens
ggaggctgagacaggagaatctctcttgaacctgagaggcggaggttatagtgagccaagatcacgacactgcactccagcctgggtgatggagcaagactctgtctcaaaaaaaaaaaaaaaaaaaaaatcctcaggattctcatggcagccatcagcctgggtgcctgccgtggccaacccttctgactttgtgcttgattttacgaacgctctgcttcctccttccctccaccttccagcctctaactgatgtgtttcaatctcccatttcttaccccacggcctcccctcaacaacagggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattcactttttccttaagatgtctttattcggccaggcacagtgactcacgcctgtaatcttagcattttgggaggccgaggcgggtggatcacccaaggtcaggagtttgagaccagcctggcaaacatggtgaaactctgtctctactaaaaatacaaaaattagctgggcttggtggcaggtgcctgtaatcccagctactcgggaggctgaggcaggagaatcgcttgaaccccggggggctgaggttgcagtgagccgagatcacaccacttcactccagcctgggcaaaagagcaaaactccatctcaaaaaaaaaaaagatgtttttactcaaaattattccataccagtctgggcacagtgactcacgcctgtaatcccagcactttgggaggctgaggcgggtagaatacctga

SEQ ID NO: 15951 - DNA, 1266 bp, Homo sapiens
ggcaggaggatcgcttgaggccaggagtttgagaccaccttgggcaacataacgagaccccgtctctacaaaaaaaatttaaaaattagctgagcatggtggcatgtgccagtagtcccagctactcgaaaggctaagactggaggatcgcttgagccaatgagttggaggctgcagtgagctataatcacgccactgcactccagcctgggctgcagggtgaggtcctgtctctggaaaaaaaaaaaaaaaaaaaaggaataggtaaaagggacagaggtgaaattttgagtgacttgagtctcttgcagtccctgattacacagaacctttctgggctacttggagcatcacgaatagtctttcctgtacttaccagatttcaagtattcataacttgactccctaagtgtacaagttgggaatagtacagggccaagttcaagtcgcatatgctgtactgttcctcctgcaaatgtggggaaagaagagggagatactagaggaactgaggctccacccattcattcagttgctctaagcaccagaggacttgtttcagaaaaggggagtgggaacgccctcgactttgccctcctccggagcatctctgggacgcagggagtctggctagcgttaataggaaaggttgctcggcagagctgccctggagtactgacttgtctctccctcctttgtcaaggtccatgtttttctggctcttcctgcacactcatccctagattatgagcgttaatgtacgaaatgtgcagagcaaattgaggccaactgtggcatcaatactgcaacttaaacttgacaatcatggtttgctggtcctcaaacaggcactgaaatctcagtatgggtatacgatttaataatcggcccctcccttctatttgtcggttttatgtttctatccttcaatagctgcactgttttctaatgtgctgtagagtttttgaaataatttatgcaagtatttggtttccatgtttacaatttatacagctttcctagcattttaaatggaaatgtcaataaatgctatgaattggtgtcaaagtgatattttctgttgatttcctttgcaacatgatagttttctcgtttgtaaaacatgaaacattggatgagatgatctttctgttctctaattttgtgtctctggtgagaacacccagtacttttgttactggtggagggtgtccaggttcttggcgtcttgaacaaagagttggacaaaacacacaaagcaaggaa

SEQ ID NO: 15952 - DNA, 1695 bp, Homo sapiens
tcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactggtacgtgtacgatgaacctgctgctttgttttctgagaagaggtttgaagacattttattaacagcttaatttttctcttttactccataggaacttattttaatagtaacattaacaacaagaatactaagactgtttgggaattttaaaaagctactagtgagaaaccaaatgataggttgtagagcctgatgactccaaacaaagccatcacccgcattcttcctccttcttctggtgctacagctccaagggcccttcaccttcatgtctgaaatggaactttggctttttcagtggaagaatatgttgaaggtttcattttgttctagaaaaaaaaaatccctcccaaagtggggcaaaaagctttatatttatttgattatccaaaatacagatcaaagtttagatctacattcttcattgtatttgctgtttcttaattgggcacacacaactcctggtcatgtcccagttcagcaccgatcgctaaggccgatcctgtagaatgcggctttcaagaggtcctaactgatcctttcttccactttgctgttgatttgttcacaaattatgtctgaatgagaaatcttctgtaagcagaagttatttaataattcccagcaccacgaaattgttatacatacatccctaccagtcacattccctgtgttcagagcctggaaatgaaattgagttcagttcagcctctctgtaatgaatcaagaaatgtaaaagagctttgagaccccaagggaaaggagagagttgcttctcatttctgattttattgtgctgttactctgtcgagtggctattaaaattgtcttatgctctttgggctaagaggggatcatctcgcttaagatgtactcctgatgtaaacatttcccccactttccaaataatggtaaagaaaacagtggcaagggctgttctgttttctggtacctgagtgaaactcagaagaaaagcaggcttagctaagagattttcactattaacctgtttttattagatcagcgaagacagtcatgcatcgcttaatgatggggatgcattctgagaaatgtgtcattaggctgttttgttgctgtgccaacatcctagattgtacttacacaacctacatggtatagcctactacacacctgggctgtgtggcatggcctattcctcttaggctacaaacctgtacagcatgttactgtactgaacacaatggtaagtatttgtgta

SEQ ID NO: 15953 - DNA, 1193 bp, Homo sapiens
ctgtagtcccagctactcaggaggctgaggcaggagaatggtgtgaacccgggaggcggagcttacagtgagccaagattgcgccactgcactccagcctgggcgacagagcgggtctcaaaaagaaaagaaaagaaaaatgttccttctgagagcttttaaagcctcatgttttgttgtcagggacatagccgagagacagcctggaatttgtccaggtgaaaatgagaactggaagctccttgtcccctggctgggtcatcactgctgattcctgatctaacctatctggggcaaagagggttttcttagtgtgttgagctgatgctatgcagagttgacctggtgtcttcaaggtccccactgctgttcttctccaggtagttagcagcaactagatccttaacccctgttctgtcttggtctggcctttattttacaaaaagacttttggaactgctaacacattttggcacagtgctggggtccagaagtctggtgtgtttgttattcataatgacatgaaaaggcatttggtggtttgctttcatttgcagtgctggccagaagagctgtgcaggagtacatcattacagcaatcaaagaagtactgaggattcacttcaaccgtgcagtggaactgaaggtgagtcctggtggctcaggagtgtgatgtctggtgagactggggctgatgtgagagccccaggttagaggcaggtgattatggccatggaatcattctatttcatctcttccctcttgtctgttcctggttaagtcctgctcatcctctggatctccattccaccgtcactgcatcgaggaggtctttcctgatcccacatgaggtcagggttagtcctttaggggatgtgttggcagagttggaacaaagggctctcagaccagaggcagcagtctggggtgacagccttcgtgattttacttcccttgattcacatgaaaggacttggattcgtgtttaaattagacgttagagtgagtacaggtgcatctttctggacatttggtaggatagagatggagatccaaatcttttagactgaatgatcctagaaagccacagtccatctagagcagagccatccggaaccagaaccgcgccccacgcatggcgatacagcagtgaaatggggctcgtccaaacggagatgggctgtgggtggaaa

SEQ ID NO: 15954 - DNA, 1091 bp, Homo sapiens
tagtctccattattgtcatgtttcttgatttttttcattatacttggttcttctttttgtctaggttttatatataccttaattaattctttcttggctgttttatatctatgttgctgtcagcatgggaatctctattattagaaagctattaacttttaaaatatgtatcttttggtgattttctttgttctaacagttttagatggcctgtttgctctttctaaatataaaatcataggtatttctattttgtttttgtgtttcataaaattgtaataagtttttttgatattttttcattacatatgaagttaattgttggttttaaacaaatgttctttgttaggataacagaaataacatcttctattcttgtttgttggaagctaaaagcttgataaaaggaattggtgtcttttgatacaatcaaatttttatcacttaaattgcctaatatgattataataagggtttttgtaatattaaaacatccttaaattcctgagataaaactctacctggttatagtatatgttcttttaatgtattatctttcctatttgctgtacatctatacattcataaataaaattcatttatattttatgtgtgtgtgtagtaatttcctttttatttttactggcatatggccaaactataaatctttttctaaatactgtctggagcttttgtaaattggtttgtaatgccatttttatttaaaaaataatgtattattgtatttttaattaccctgttattatttaggaatattttcccaaaattattttttgaaaatatatcattgtggaaattttggagagtacaggaatgtatgaaggaggtcatattaatcatctcataataccactgtataatcgctcttaatactgtatttttttctttctttcttttttttttcttgagacagggtttctctgtgtcacccaggatggagtgcagtggtgcaatcacagctcactgcagcctctgcagcctctgcgtcctgggctcaagtgatcatctcacttcagcctcctgagtagctgggactgcatgcatgcatgggccatcgcgcccagctaatt

SEQ ID NO: 15955 - DNA, 1162 bp, Homo sapiens
ttctatatttgttcacatcgtacataatcatgtttttgcacagatacattaatattatcatagtttgtttaactacttggctttttctaacagtttttttttttgagatggtcttgctctgttgcccaggctggagtgcagtgacgtgatctcggctcactgcagccttgacttcctgggctcaagtgatcatcccacctcagcctcctgagtagctgggactacaggtatgcaccacgaccagctaattttttgtattttttttttgtagagagggtattttgccatgttgcccaggctagtcttgaactcctgggctcaagcgatctgcctgcttcagcctcccagagtgctaggattacaggcatgagccactgcacccagcctcttaacaaattttgaatataactcctgtcttaaaatctgcagaatattgaatttttccagctattttttacttttgcttagcttatagatgctaaaggatactgtcatttgcatttttaaaaatatatgtatgagtgaatagttttctggtgtctgctttctgattgttcttattttttcattttatatttggccttttattaatggggccctcatctatgctgatgtgggacagcctttaacgaggcctcaaattttcatgaaaggacctcagcaatactgtgcttggatgatattcaatttttgtaggtccatcctcagccagtagtacagagtatataacctttgggttctctccagagacttctacctcactctgtctactcttttttttttttttggagacagagtttcactcttgttgcccaggccggagtgcaatggcgcgatctcatctcaccataacctccgcctcctgggttcaagtggttctcctgcctcagcctcccaagtagctgaggttacaggcatgagccaccacgcccagttaattatgtatttttagtagagacggggtttcaccatgttggccaggctggtctcaaactcctgacctcaggtgatctgcctgcctcggcctcccaaactgctgggattacaggtgtgagactctgtctactcttcatttcttgctgagcttttaccaaagcccagtcacaatagtttgaaggatgagcagtatatccactcctttaaattgtatccattcttcctg

SEQ ID NO: 15956 - DNA, 2225 bp, Homo sapiens
tttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaatttggttctactgcctttatttgatctatttctaggtatctcccaaaacatcatcaactgcagacaccagttattcaatgggagagagatgatgtgttttgccccttccagctttatcattccagggttcgatgaccaagtcacctgggcaaggcacagtggtggtgatggcccccacatcttttgtctggggatttagagagggaagggttgaaagctgctaacac

SEQ ID NO: 15957 - DNA, 1143 bp, Homo sapiens
ttgcgtctgcttcagcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacggtaaatacaaagggaagacactttgggctagtacatttgttcatgatataccaaatggctctagtcaagtagtggataaaactactgatgtagaaaaaactggtgccactggttttggcttaacaatggcagtcaaggcagaaaaagatatgttacgtactggaagtcagagtctgaggaacctggtccccaccacacctggggaatccactgcccctgcacaagtcagcactctgcctcagtcacctgctgccctttcctcaagcaacagagctgcagtctggggggcccaagggcagaactgcacccaggttcctgtttcctctgccagcgagctcacaaggaagacaacaggctctgctcagtgtaagtcactgaaggacaaaggggcctctgtgtcttgagtctgcagcagagtggctatggctggtggtttttccttggatgttcccc

SEQ ID NO: 15958 - DNA, 1164 bp, Homo sapiens
ctcgctagggtctgctctttccgggaatgggtggggtgcgcactcctcaacagggctctcaggacttgcgtcacacgcctcagtcggctggcttataaaacaccggccagagccccaagatcgcttttagtttctcttctttctaaagaaggctcgcggagcccggctggagaacctcaccctcgccgagcctagaaccgagagggggccaccccaggcggtcaccagcagatttgcccgcgcgttctctttctttccacccagttgcccttgcggccggctgtaaacctgccactaggacccggtcggtgagatctagcctcttgacctgagagccgagagtggatcgctgggctgggctaacggcgacggagagcgcgccctcgctgactccgggcgcgcccagcagtagcaccgcccgcgcccgcccctggacacttgtaagtttcgatttccgatttccgcggaaccgagtcccgcgccgcggcagagccagcacagccagcgcgccatggcggacccggaggtgtgctgcttcatcaccaaaatcctgtgcgcccacgggggccgcatggccctggacgcgctgctccaggagatcgcgctgtctgagccgcagctctgtgaggtgctgcaggtggccgggcccgaccgctttgtggtgttggagaccggcggcgaggccgggatcacccgatcggtggtggccaccactcgagcccgggtctgccgtcgcaagtactgccagagaccctgcgataacctgcatctctgcaaactcaacttgctgggccggtgcaactattcgcagtccgagcggtgagtgcacccggagggaggggcgctgtccgcagccgtggtcggggtggactgtccaggcgggcaatgttctgggaggggcacggcttcgccgggaccccgcacctgacagcctccgcctccagccactcccttctctgctcccctctgggagcctctgcagggcccgcgcttctacctttgcagttcccttccttccggcacctccagacattttctcgagaatggctaaaatgctagtgcctggaggagaccaggctcaacctccacccctttccccgcccgcccgcacgaatcagaagaataaagtgctctggagccagccagggcctagagaagcggtag

SEQ ID NO: 15959 - DNA, 1120 bp, Homo sapiens
agaaaatggcaggagtggaagcagccaagaagagatcgatgactgaagatctccttcaccttcaggactgtctcaaggggttatttcacctctactcatgaggatggccagtttttctgtcttttatctttagacccatatataatcagttcagagcacaaatcaaaataaactggcctaaataactgaattctaggaagcaaagctacatcttttttcatatgccaaagcttctgtttcctcatgttgttcctactttttaaataataaatggctctcagcatcttaggaactagatgggtcccatctgggtagaacctgctataatttttagaatcactcttgtaattcttacctcacttaaaatattaggaaacacagtaatagaaaagacagggagaactcgtctgcaggttttggcagtgaaatttgtcttccagtgaattgctattattttcaaattgcctatagtcaaaaagcttttccattgatggagacttactttcaaatgagcttgtgttgaattcagcactctagattctctctgacattttcctgtcttttgggaaaaaaaagcagatattccaaaaatggcagaaatctaatttttgtaaactttttcatctataggattgagccaaaaaacatacatactattttaaagaaaggtaccatctaattcttttattaaagatagctacttctgaaatgtcttaacagagtttcaagattgcaaagtagtattgcatagctggttttcttacatgtgatgatggaggagagaggaagacccagacttaggcatgtagtgaaatatgtacagtttctggcatcagtgtactatttatagtctatagcatacattacttgcaaatgggaaaagtattttataattatttttgtacctcaaaataattattatattctactgtattatattcaaattaaagtttattatttgattcttagtatgatattctgttgagtgtgatgagggtgggacctaagtatgtcatgtgccttctaccctttctttcctagccctagaatgaaaggagagaaagttttgggccccataagttactctttagaagagagaaaagtacatattccccaagaa

SEQ ID NO: 15960 - DNA, 1166 bp, Homo sapiens
ttacctatttgcctttcgtgggtgacattccagattatactgaagaaggtgctattgtaatagtataagttaataagaaattaagaaaactgctctgtcacctgtcaaattattattttaattctgtgcctgcttatttatgtgacactttaacgtttaaaatcacacatagcctaactgatcatttttgtcttcacagagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagtaagtgtaataattctcttgctttttatttgctgcacaaacataagaattaatgcttttgttcgtttgtttttattttccacataacactggtataattgcttttgttttttaaagataaaaataataaactacaatctgaacatttttataactttttatttgccatgtttccttttagacctttcttttttctttctttctttcttttttttttttttttagtagagacggggtttcaccgtgttagccaggatggtctcaatctcctgaccttgtgatccgcctgccttggcctcccaaagtgctgggattacaggcgtgagccaccgcacctggtgttttattttatttatttatttatttatttattttgagacaaagccttgctccgtcgtcacacaggctggagtgcagtggcgtgctctgctcactgcaacttctgcctattaggttcaagagattctcttgcctcag

SEQ ID NO: 15961 - DNA, 1276 bp, Homo sapiens
tatatgaatgttccttccacttggtgttaagtatgacagctatgtgcaatatatcagatactttgtcttgtgaggacagctcagtcaggagctctgtcatctcaaaaattatttttgttttgatagtctctgaagatttccagtagaaaaacaattgtaattgtcatgagaatcttttagttatttaaaattaactttgtaattttttattcaccatttctatttttttccatatgatgctttacattaggagtgtagtccaaaaaaggaccagaaaactccaacatccctggtggcttcggttagcggtcctccaacgagctccagcacagctgccattgctgcagctagctctagctctgcaccagcccaagaaaccatctgcctcgacgactcactagatgaagacctttctttccattcaccttcactggatcttgtttctgaagctttagcggttatcaacaatgggaacaagggccctccagttggctcaaggataagcatgccaaccacaaagcctcgtccaggactgagagaagaaaaattagcaagtatcatgagtaagctgccactagctactcccaaaaaactagattctactcagactacacattcttcaagtcttattgctggtcacacagggccagtaccaaagaaaccccaggatttagctcatactggcatctcttcaggccttattgctggttcttccattcagaaccctaaagtttctttagaacctttgccagccaggctacttcaacaaggacttcagaggtcaagccagattcacacttcttcctcttcacagacccatgtctcctcttcttcccaagcccaaattgctgcctcttctcatgctctgggaacatccgaggcccaagatgcttcttcgttaacacaagtaacaaaggtgcaccagcattcagctgtccagcagaactatgtgtctccattacaggccaccatcagtaaatcccagaccaaccccgtcgtgaagttaagtaataatccccaactctcctgttcctcctcacttattaagacttcagataagccacttatgtaccgccttcccttatctaccccctcacctggaaatggttctcaagggtcccaccccctggtttctaggacagtacctagcaccactacctccagtaactatttagccaaggctatggtgtcacagatctccacgcagggtttcaaatctcccttctcgatggctgcctccccaaaacttgccgcatctcccaagcctgccacatct

SEQ ID NO: 15962 - DNA, 1102 bp, Homo sapiens
tatgcttttgaggtcagagggtaaatgaaatcgtgattttaaaacagcctgaagaaaaaggttttgggaaaggaaatgaggctaatctgtagtcataaaattctgatactttgcggaaattagaagatggtgatagtgcattcttttgtgcccaccccccctctgatggatgttgttagcccaaattacatttttcatatcatggacattgaatagggtttattgaatcaggaaggtaaggggaagaaccgggcacatatgtgttggaatactgtgggtttgacacctggttgaaaacaacttattggacatgatttttaacccaggatatttttttcccaaagcagatctaaattgtttactacccagggttggaaagggcaggcacctctaatctagtctttgtcctctggttgccctctcccacacccctttccacctatacttggttcaagacattttctgaaacgaaaattctgctgttgttcaaactgccattggttatgagaactctgcgtcctttgggatcatctcttagaactccagtgatctatcatatttgctgctacatttgtaaaatgaactttgcctgtattggttgactttaatttacagttctttatttctaggatgttttgtcctctagtttgactcatgtatagaattaggatactttattttaggagtgtaccgtaaaagcacactggtccctttgttgtttttattatttaggtttggaatttgtttgctttttttttgtttgttttttgttttgtttctgtttttgtttttttttaaagttggaaatagaagaatgagaaaaatctataatcaggccaaacttgagaactttcctgtgcttcagcactgtaattctgctgacctaatgttctcaaaagaggcacttttactttctattgtgcatgtatgattgttgttttttgcttttgagggggcttttgtgtttgtaataatgaagcagaagaaaagtgcagtagtagataaatgatcacaacatgttatgcaattttattttataaaattttaaggggaaaagtttaactctttgtaaatcatttcttagctctggtaaaatgcttat

SEQ ID NO: 15963 - DNA, 2439 bp, Homo sapiens
atattaaattttatttttctcatagactctcaaagtaccacttgcttgaaagtagctacttgtgatctttaatttccttatattgtgatagttctacttttcagtctttcctgtgtatctccatttcatagtgcgttagtacttaaacttcggacacttttccaaactgttaaacaagtcaggaatgcttttcagaatcgcagtagtattattagggtctctgtgtctaggacttacagtcatcagtggtcatcactgggactagaggtgttcttttttttcctcttctcctttgtattaaaaaatagattttgctactgtataatgcggcatttcatgacttcctcttgttacttttcaaggttattctaaagagatggagatcttcattagaggctatttctcataatagtctgccttgcttattttcatactccccctgaaataagcctacttttgcaaacaggccatatgaatcaaattttatgtttgttcctcacaaaattttctacacattatttgttcccactttgctaataataatataatgattttattgtaaatctgtgttttaaatattttataacagagcactaatggaaacctaataaatacaaacaagataactattacccaagataacatggaaatacttctgtttttgaagttaacaacaccgtctgccctcaaagcacatttaggagtatcaaccaagaccagccagttgacatgtttttctgtgtggcaacctgcccttaaattgtcagatcttaactatcttgtgtttgctgtgcttgcagccataagctttcctccttttttgcttatccctgctgtttgtagggttagtgtgccctctgtcagaaaattgggttttctttactatacctgcaaaattaccaagggttaccccaatattgtctagaggaattaaaaagaacttattctcagttgacaaaagtattactgttatacatagttaattggaaagttggccaactttggtcacctatttttgagtcttggctatgcctttgtaattagttacatataccttctgagaccttcagataatcaatgggcctttccccattagaggtaggttcccagcctacaagtatttcctgtgatccatggcaagcctccagagaaaagattcaagctttgcactgcccttttgttgattgtcattgaaaacttactttatttcagaaagtatcaaaaataccaaattggtctttcagagagtatgtaaatctggggcttgcccttggatttcacttgttaaacaccctcaaacttaaaagaagaaaatagatctccagctggtgaaaattttgtgccccaaataatatattaatccaagtctaccaaggtaactaagtaatggatgttttctctcttttattacaagcaagaaagttcatttgcagttgtaaaaatgattaccgaactccagacctatttgctataactgattggaaataatgattctgatttttagtctgggtaaacacatacttcggtgtgaattttgataagggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagtaaaaaaaaaaaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaacc

SEQ ID NO: 15964 - DNA, 1129 bp, Homo sapiens
gtctgagccgcaggtcccctgggatttggggagacgtcaatacgttgaattttgatatcccttttataaatcatttaaaaatgtcttctcagcgtgttccatatcaaatccacacccacaccccccgccgggcccgcttctcctgagactcagcggttggtcggctaacgggcatcttcaatgacgcagtgaagaaaagcccctgtttccccaaacccttgttctgggttagaggtcctggtaccttcagttaacagtcgggtttcgtttgattttgttacggcgcccctgggccttcgattaataaggttcggtcaacggacaagtgagcggttccactgctcgtcagtcgatagggggagtcggtagtctgtccgaccgtaccattaggcgcctgggccggaggaggggttttcagggtcgtaggacgccgttgggcaccacgctcggagaaggacaggacaatggcggccttagggtccccgtcgcacacttttcgaggacttctgcgggagttgcgctacctgagcgcggccaccggccgaccctatcgcgacaccgcggcctatcggtaccttgtgaaggctttccgtgcacatcgggtacgggagccatgtcccgggtgctctacgtgctggggagggaggaagagccgggtctgggctagggtggggagcacggtgtttaattcctgcatttctgaggccaaccctcccacggagccctggttctgaccaaaccaacccaggccctaggctccatgctctggcataaactcggggaccaaaggaccagcgggggggggcgcagagtcgctctggggacgtcagcctgtcctgcagaggggcggacccgtcccgaaggatttcattggctggtctgttgcctctgcggagggcagtcaggaaagtggaatggaggattcaatgctggggataaaacaatgaagatggagttgaagggtgtactgttgctagacttaaagccacagcatctggccaacaatttcctcacccgtcccctagaaaagttattctaagaagcatttctttttgaggcggaaaagaacaactgggctttagggaaggaaacttgctgcccttgagcaatgtggggaaagggagaacga

SEQ ID NO: 15965 - DNA, 1129 bp, Homo sapiens; identical to SEQ ID NO: 15964

SEQ ID NO: 15966 - DNA, 1091 bp, Homo sapiens
actttttaaagaaataattttttaaaaccccacttggctcaaagacattgtccagagctccagctttggacttttacctgtagtcagtcatacaattatctggggttatacttgttaagtcagtatttaaaaaaatgaaacaccctgattttgttcacttttgtttttatataaaagaatctttacagtcaacatgtacttctagatgctgtattgaaattgctggcagagtttattctatacaaaatgaacaatctggccccttgttttatttgtaaaggttcaatgtatctatgcctgcctacctcaatctgcaagggagtgtcagaaaggccccgcattcgccaagccgtgagttatcgctaacttttcagatgtgttaatgaatgtggaacaaaagcagttgtgtttaaaaggaaaaaggaccatcaaaataacttttattatagtagcaggcgtaaacactaaactgaatattccaaattgtgtcaaaaataacctactagagacgagcttctagaaaacctattgttgaactgctctgaagctatcattttaactataaattactgttgttaaaattttatataccctggttgcaaattagaatgttttaaaaatatctttaaccacgttaaaacaatttgaacaaaatcttaccccatctaaaaatgatagtgtttagttgaatttaagttaagctctttagtatatgaccatatgaaggggtaaagttttaatcttttttgttatttacatgtgaaaatacagaaactaagtgattgaatcacatcctacacgaaagtttttggagtgctccaggcatatcatgtgaaatacagaggtatttatatctcttttggcaccaatagttcttgcttcagtaattcaccagtaggttttcattcatcgataatatatcagtttaaggctaaaataaaacacctacatttcttagggcttatcattctatatagaaagaggaaacatcctaatgagttttttcttttgtttttccaaagagattctaagcaaaaaaattttaactaacatctatattttgttattggagctagttacctttctttttc

SEQ ID NO: 15967 - DNA, 9703 bp, Homo sapiens
ccagtctggtttttgaggactccatctttatttgaaaaataggatgttcttcaaagcacattgacatctcaacaatttgatgtatatattcttttagtttggtttaaaattaacttgatcttttttgtgttgtggagctaaatgaactatgttgtgatatagaagctagcttttttcagattctgaaaagcttttccatatccatttattcttaaatacaagtgatccctgttcccatctgttggtagacaaaattggtgccatttttttcttctgacaccacgttttatatttgtctatgaaattttgtaatttggaagcccctacataaaaaagcatctgtatgacttaatatgtattctgacaagaactgtggttgttgaagcattttttaaaaaacttttttttgttttaatattatgtcttttttcccttccagagaatggatcttggagaatgtctgaaagtccatgacctggctttaagagcggattatgaaattgcatccaaagaacaagattttttctttgaacttgatgtatgtgattttgctttaatggtttgttgttatcttttgctgtaaaacattgtgaatgtggattaagatctcttaataggaaaaactcttagcagtttatcctctggttatatgaagggtaagactcaagtaagatcatgtactttcttgacaactcttttaaaaatatgaggtgagactgtattttaagaaaatgtgtaacagtcgtatgattcatatattcttttggaaattaagcatattcttcccaacaaaatagtaatgattaaggaaatatcaagcaaatgtaagcaactaatttatagtgtatataaggacctatctttagtaatatactgagtttttacattcatatttatttttgaatctacttatatatatatatacatgtatatatagttggccccccatatctgtcgttgaatctgtagaaggaaccaactgggattgtaaatatttagcagaagaaatggattgttgcatccgtactgaacatgtacagacattttgttcttgttattattccccaaacattacagtataactgtttacatagcatttacattgtattaggtattataagtaatctggagacattttaaagtatatgggaggatgtgtactgggagattatatgcaagtattacaccattttatattaaacgtgcattcatggattttggtatccgctgggtctcctggaaccaatctcccacagatactgagggacatgcatatgggtgtttgggggattttttttttttttttttttttttttttttttttttttgagacagagtctcgctctgtagcccagactggagtgcagtggcccaatctcggctcactgcaacctctgcctcccgggttcatgctgttctgctgtctcagcctaccgagtagccgggactacaggcgcctgccaccacacccagctaattttttgtgtttttagtagagacagggtttcaccgtgttagctaggatggtcttgatctcctgaccgcgtgatccgcccgcctcagcctcccaaagtgttgggattacaggcgtgagccacggcacccggccgtttgggggatattaaggacagtgtttttaatgaaaaaccaagaaatggaagacaccatttagatacctaaaaaagcctgaaatgtaactttatattgctgtttttatatgaaaatcgtttgcataaaaataaagtttttttgcatatatataatcagcattacataaaacatactaatgtgcataaatctttgatacattttataagtgaaataatagatgttttaaatttggttttaggagataaaccaacaaacaggtcctcttgtcttctgaatatccaagaatttctgctaatggaaatgaaattgttttcagaaatataatttacaacacattttccctacttttttggtggtttttggccttgcgggggtatttttatatttatatcttctgatttatcagtctttaacaaatctatagccaggcgtggtggctcgtaatcccagcactgtaatcccagcactttgggaggctgtaatcccagcactttgggaggccgaggcaggggtggatcacctaaggtcagtagttcaagaccagcctggccaacatggtgaaaccccatctctactaaaaatacaaaaattagccgggcatggtggtgggtgcctgtaatcccagctactcaggaggctgaggcaggagaatcacttgaacccgggagtcaggttgcagtgagcctagatcatgccactgtgctccagcttgggggacagagcgagactctgtctcaaaacacaaacagagaaaccaaatctatttcattagttctaaacgcttttctttttctgaggtgctaagagttctctcctgtggtttcttctggcatattttggcttcattttatagacttttaagtcctcgattcatctcagatttattctggtttaaggaactgagatatggatctagtctccccccaaccccacatagctacttagtcacccaacactatttgctgattagtccatcttttctctcactgctttgagatgccatctttatctttacataaggaaatttgaatagatttctgttgtgatttaaaaattttcaaattaaaagaaattaactatttttatgttatcacagataaaagctgtttaagaaatgatccttattgcttttcacattgaagaaattcttgggttatccaactatttttggaattcaatgtgtgctgaataaatttgtatttttagttcaaacatttgtatcttgaattagttatatttctgtacagtaagatttggaagtccaaacttgagaatgaattcttaaagtttacttttaaatgaactattaattgtagacattaatatgtgcctcacaaatgtcttatataaatattgaatttttatagtgtagatactgctaaaattctcaatggtttattctctgaaaaaagataagttttcctgatgtgcgagactcttgtctcaaaaaaaaaaattctaaagcagtttggagaattaaaagaaaaaagggtaaaaatgttcggaaatacttactgttagcattttgtatagttttccattttttctgtattttctttttgtccattcagatctagacttgcagcagatttttctgtctttattttacaaaattgggatcttactgcataacatttgtaatttgctttttatttacaaatgaatcctgaacatttcttcatgtcctcaagtgattttttttgagacagtctcattctgtcacccaggctagaatgcagtggtgcgatcttggctcactgcaacctcagcctcccaggtgcaagtgattctcctgcctcagcctcccgagtagctgggattacaggcgcgcactaccatgcctggctaatttttgtatttttagtagagacgaggtttcaccatgttggccagcgtagtctcaaactcctaacttcaggtgatctacctgcttcggcctcccaaagtgctggaattataggcgtgacccaccacgcccagcttcttttttttttttttttaatgacagggtctcgctgtgtcacccagactggagtgcagtggcatcatcagggctcactgcagcctcagcctctttgggcccaagtgttccttccgcctcagcctcccgagaagctgagactacaggtgtgccccacccacctggctaaatttggattttaagtagaggcagagtttcgccaagttggccaggctggcctcaagtgatctgtctgccttagcctcctaaagtgctcaattactgacgtgagccaccgtgccccaccatggtagcattttaaaaagcaaagtgtgatttttgtatgaagatatttctgaataaaattgactttctgacagtaattgtctttaattaaactttgtaggccatggatcatctgcagtcattcattgcagattgtgatcgtagaacagaagtggccaagaaaagattagcagaaactcaagaagagattagtgctgaagtagcagcaaaggtaagaattttaatcatttcattagtacaaagtattatttcgactccttttgtttaagtttttattttgaaataattagatttgcaagagattgcaaagacatatacaaggaattctgtatactttcttgtctgccccagtgtaaacatcttatacaatatagtgcaatatcaaataaattgacattggtctaatccttatattttattcagattttgccagttatgcatgcatttatttgtgtatgcatgtctgtatgtatagctctgtgcagtttttttgtttttctttttgtttgagacagagttttgctgtgttgcccaggctggaatgcagtggtgtaatcttggcttgctgcaatctctgccttctgggctcaagtctcgtgcctcagccttctgagtaactgggattacaggtgtgcgtcaccaggcccagctaattttttttatttttagcagagacagggttttgccatgttggccaggctggtctcaaacttctggcctcaagcgatctacccaccttggcctcccaaagtgctgggattacaggtgtgagccaccacgcctggccagctctctgcagtttaatcacatgtgtaattacagccacagttaggatgcttaagtataacattgccacaagactccctcatgttaccccttttatagctacatccatctttacccccacccagcatctctacccttggcaaccactaacctattctctatctctgtagttatgttatttcatggagtgttacataaatgaaatcctgtgtacgcttttgagatttggcctttttcattccatataactttcttgagattcattcaagttgtgtgtatcagttcattcctttttatttctccattgtacagatataccacagtatttttatttgcttttaaaagcaaatgttaaatgtcaatatttcacctgtaagttataaccacagtaatacatacataaagttaacagtaattttttaatgttatccagtgtatgtttatttttcttatagagtcgatttattagaatccaaacaaggtcttttatattgcatttgttgatgacttattacaacataattatattccattcagtatgatcaagtgtgttttatgaaaatgcagaatgggagaaaaagagttacccaggtggagtttagatgacagtattaaaatatggtgttcagatatgtatatacaaatgaaaatagattccatcgtttgagaaaagggttgcttttagtcaaccttttctgaaaattctctgaagatggggactggaaagacgggcatcctgaagtacaaaggatctagtatctcatggttggaagagatctgtaagtgcttggtagagcctgagttgtattggttgtattggttatccatcactacacaaatgctgtataacaaaccacctcaaagctcagtgacttaaaacactatttatttagcccatgactctgcagtcagtgatttaggctgaacttgactgagcagttattcttgtttcagctgggcttactcacatgccttgcagtccactagaggatgcagagccatgcccagcaggctagcctggccgtgttctcatagtggtggtagaggtgcagaagcatcaagccccatcacacaggcctctcctttggtcatgtttgctaccatctcagtaaccaaagcaagttcatggccaaattcagagtcagagtacgatggtacacaattacatggtcaaggacatggatacagggaagaaagaagagttttggacaacagtttagtcattcaatgatacatttaaaggaaaataccatttggtagagagggaggatagtgataatagaattggactctcattgagggaagaaatattttgggttgaaggatatttgagaagtaaagactattaattaaaccagtaaactggtttgttgggactggaaactcataccaaactaaaaccttcggccgggcgtggtggctcacacctgtaatcccagcactttgtgaggccaaggtgggtggaccacttaaggtcaggagtttgagaccagcctggccaccatggtgaaaccctgtttctacaaaaactgcaaaattagccaggcatggtggtgcacgcctgtaatctcagctacgtgggaggctgagacaggagaattgcttgaacccaggaggcagaggttgtagtgaactgaaatcatggcactgcactccagcctgggcgacagagcaagactccatctcaaaaacaacaataacaacaaaaaattaaaaccttctttgctaacatattataattggccatacagcaaagactttgtggcccaaataatgattatatgtatgttttatgtgccattacaacagtaggaatgaactaagttgctaggatgatgatggtgatgaggaagaggaacgtattctttcccaaggccagagttaatcctggtggaaagctaaggactcatagagtggagttgccaggcgagtatgctgaaaatcagcaaggtgctatgcagggtacatacgaggcttattttctcatttctcacaactttgtgggataggtacttcttagatgaggaaatgaattcaggtataagtaatgtggccaaaattacacagatagtaattggtttagcaataagtcagatctgatggattcctgaacttgatccaccaattcatttctttaactcatatttgagcctaggctatttgctgagcactagagatacaaagatgggaaatacagatagctgtccttaaagtagtatgatatttatgaaaggaactgtcaaaaaagatacaaaggtgacacaaaggagagagtatggccatctttgctgatgtgtttaagtggggctgggatgtggtgactgttcaggaatgttttacagaaatggcccttgagttgtatcttgttggaacgagtgaatattcagtaggcaggcgagaggtaagggatcccatcccagaaagaagagtatatgcaaagtaacagaggtagaaaacaacagggtaagtttggggaaactataaattatgttgtgaggtgggggagtagcaagagatggtttagaaaagtacaaagggccagatcatggaagaaatcgtattttacactaggaatacaccacctcgccagaggatagaaagttatattgggcccagtagtagccctgacttcattgaggtaaggcaggcaggctcagaacatcctgatgtctcagtagttcatttgggatacgctcagaaagcattctttaaccacatactgccttagataacaagttttttctcagcagttctgaaatactttgaaatttaaaattcattctcttgtttattcatgatcttcttttttatttctttttaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggtaaattcttaatagtagtagacgaattctgcttaatttggtaagactacaaataaaaagtagtagatgaaacttcagtatctatacttctctaagaacatgtatttgaatggaaattattgaacagttgttaaagagaagttgaactaaaagacaaaaacaaaacaaaactcggaaaaagctggttgtggtggtgcgtgcctttggtcccagctattttgcaggctaaggtggatcgcttgagtccagttcaagtccagccttcttctttttgtttttttgagatggagttttgctcttcttgctcaggcaggagtgcaatggcatgatctcagctcaccgcaacctctgcctcccgggttcaagcgattctcctgcctcagcctcccaagtagctgggattacaggcccatgccaccacacctggctaatatttatatttttagtagagacagggtttctccatgttggtcaggctggtcttgaacacccaacctcaggtgatccacctgcctcggcctcccaaagtgctaggattacaggcatgaaccactgcaccagggccttttttttttttttttttaagacagagtcttactctctctccaaggctggagtgtagtggtgcgatctcagctcactgaaacctctgcttcctgggttcaggcgattctcttgcctcagcctgctgagtagctgggactacaggtgtgcaccaccatgcccggctaattttttgtatttttagtagagataggctttcaccatgttggccaggctggtcttgaactcctgacctggggtgatctgtccacctcagcctcccaaagtgctgggattacaggcgtgagccacccggcctggcctgtttttttgttgttgttgttttttaaaatacttttggtaaatttgtctttcagaaaatctctctaagttgtatttattgatataaagttgttcatagtgttctcttttaatatctgtagaatgtttgcaattcgtgtcttttcttaattaatctagctggtcagttttattttgtttttcaaagaaccagtcttctgattttattgtttttttcttgttttctatttcattgatttctgttcatgtttattatttccttatactccagtggagagaggcgctaaggatagaggatggggataaagggaacctataattttcataacaaaatagccatgcttttgtggtttttttttttttttttttttgagctggagtctcgccccagtgagccaccgtgcccagccacttttgtgtattttttagaaaacacttttggtataagcatagtatattttatttaattgtatgacttttagtgagatttatatggtcattgtttttctcacttttgtttaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaaggtacattggtaaaatattcctcactttatcctcttgttcttttgatctgtatcagttgcctttttgtacaatattcttgactatgattcagtaatatagtatctaatgattaatactaaacagtgtaggattatagatggaaattcaagttggtttaatggatgctgcctgagaaacagacttaatattatcctgttattttgggagttaccattttatattagatatgacaccgagttagggatctttcaaactagttactaaaagagtcccataaaacttcattgttattgttcttttcaataaggtcaataagaatgtaataatataatatttataagaagtttgagaaaatgaacccaatattaatttgaaatattttgcaattctttattaaatagcaagcttgcagaatctctagttttattttatgctcctgcttccacttcagaaaggacttatgaaaaaatttatatttttttaaaaggacaatcactattacttaaataata

SEQ ID NO: 15968 - DNA, 1136 bp, Homo sapiens
gccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtc

SEQ ID NO: 15969 - DNA, 1211 bp, Homo sapiens
tagccagcttgatcttggaatttaaagactatgaattctctgtgggctgaaaataatgattacttcatacccccggtcatcgttgcttaagtgaattctgaaaatagctcatctttacaacaaaaattaaaccaaggaagagattattctttgtgtgttgtactcaaatgcgatgttcaaatgcacatgttaagtatatatgtttttagctactgtaaaatgctgttagccttctaagctatcaaaacagtcacattttaaatgagtaaactaaacaattgactgtggatacttaagcatatttctggctacgttttatagttaaagtgttttatagtttacatttagactggtactttttaaagaaaagttctgtttataactgacatccgcaaaccccagtgaatgcctcttagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccacc

SEQ ID NO: 15970 - DNA, 1844 bp, Homo sapiens
ttctagtcttcctggtggctgaggtgttcacgggctgggggagccagctgacctttgtcctcttcaacctagaagactcagcccgcccagacaccaacgtgtgagacggatggacatcaggaagggaaggggagattagcccaactgctgacagaacgatttcccttggttggaccttgggaatggcaaacactcatattggaacaagcttggggtggaagatttaggccgtgtgagcatgtgtgagtgagtggaacaaactttcttggaaactggagggaggagatgaggaggcttcgggaagtattactgatggctcatggttgagagagcgacgtggggacccagctcgccccagcttttgtcccaggttctctttgtctgatgctgagggcagggtggggtgtgggaccaccactcttgttggcctgtcaagtagaccctaggacagaaaatggaaagaaggaaatggctcggtgctctcaactagcagagagaattgaggagaggtaagggttccttctgcaggccagcctgggactccacagcgccagcaggagtgacttggccacaagacattccagccccagggactttgcaggcttcattccctgtctgtgtcttttccttctggtgtgttttacagacttctgatggggaagcttcaaacttgagcaggccagagatgtccttaccaaattggaaaggaaggtgaaactgttcctttctttagccaaagaacccttctcaaagacgcctccagaaatggacaaaatggccttcccttcgttcctttccaggcaataatgacatcattagtgatgcaattctatttgtctttctctttcctctctgtccttttttttaaaaaaaaaaaatgcatttatttcaaaactgtgctattcttttaagaggagtggaggtgaccccttcgatgctgctgctatcgggagacaaggtgccataccaatacgtgggcttgactaatcccaggccaccatgggagagagcaaagcagggctgccaggagttcagttgcatcaagggcgtagagcacgcgggggctgggctcggaatagcagtacttttccactttgatgccttagaactctcacttctcatctccacagaccagactcagtaaaatctcaggccactagagaatggaaggcggtgaaacaggatttaaatgcaaaaaaaacctattggaggcttttggcaccgtggctcactagagggacccagcatagtagaggtttctcttgttgcagcttctgaaaagttcaaaaaagaactccaggccgttcttccctcaaacccagtgagagtttgcagagaagtgccccctgcagggctcccgtcccagaacaccagcaccagagagggtcttcccgatgccccccgctggacttgcccaagcctctgggagcccctcatctcagatccctgtgttgaacatgacactgactgtcccttatttgttaaaatttgcaatatctctcaagtaaataatagccaacatttgttgaatgctttcatgactcccgggctaaggcctttatgagcgttgtctcaaggggccccaacagccatcccacagggagggggataacagcccccatttatagataagggagctgaccggatgctctgagaagtggcaggtgttgaaggaaggataaagcagtgatgggccagaatccccaaggttcccttttttgttcatcaggcccttcctgagatgtgatttttaatcttttaactttttttaattaatagcaatgcgtggcctcatatttctatgaaccatttagtgatactcccgcttcctgcatgccacacac

SEQ ID NO: 15971 - DNA, 1128 bp, Homo sapiens
cagcagcctggccgtcccccgtctttcctgactagggagcccggactgggcttcgccaatcccacaccagctccaaacatcagcctcctcaggctgcagcccgacattctggagggctgttgaccctttcgagttctggaaaaatccctaaatcttatgttcaattaattaaaaatctatttgatttccatatcaggtgtccctgacagcagtcttccgtatcacttgctgccatatgaaaataatctttgaaaagttcataaagttcttcaaaaactggggccccccgtttctggaatcttcctgttgctctcttctcctttccagtttggcgtagaatgggttcttgagctgggttttttgttattgactttttttttttcctttttcttttttaaaataaaaaccatagatttcccaccctctttaatcccttccttttaaaaatgttctcttctctgctctacgtcctcccacttcccggttcaagtttcactggtgtcccgacccgtccccctgccctctgcccccccccccccccccgcccctgccccgtttgcattgtttgtgtgcggcatcttcagtataaaaggccagcgcccacggtcccaggagcgcctccctccttctctccctcctccctcgggccattctctccctccctccctccctccctcccctccagtgtttatatgtaagggtactggttgaccttggcggggctcagtgggtatccagtgtagacggtggaggctggcgaggcgctgatgtaggtctggtgggcaaattgggctggatactgactcgggtggatggtgggcgagggcaggacccgggggcccatgctcacggggacctggtggacgatgctggctgggtaggcagtgtgctgcacggtgtggcgcgcagagccttgcgaggccaccaggtgggccacggtgccggtggagcccagggccgccggcgcagtgtaggtgtagaggtggggctgggtggggaggtgggcagcggcagcggctgcagccagatgcgggtgcacagtgccgtggctggggctgttgtgcgggaaggagtacggagcctgggccatggtgggagtgatgtaggcctgctgccttcggtggctcc

SEQ ID NO: 15972 - DNA, 1257 bp, Homo sapiens
tcactgccttcacatgcttgttatcttgtctaataaacccccttggcttctaaattgatgaccatctttgaaacttcatgctatctttgggtctttcctttgatcctcatctgcagtcaatcaccaagttctgtcaactctgccttcaacacatgtcttgagtgagttcttcattcttactcctaactggcactgccctatatcaggtcgtcgtctctcccttgggcatagagttttcagtagggtcctgaactggcctcccagcctctagcttctcctatcatcctccaatcagtcctccacaccaatgccagaagaagcttgctcatatgcaaatctcatcatgttgcagccctgctcagaattcttccttggctccctgtcactttcagttcaagcactaacctcctttatttggcacctagggtctttggtgatccggccacagcttgactgctagcctcactgtaagtcatctctgtccctaaattaggcttgggcaatcttgcatgactcacacgttcctagttacgccatgtcgtttcaccgttctgggctttttcccaggcttttctctagggccaagacaaaggagaggcaagaacaaacctagggtacaaaatttaaggaggtcctcactctcagggctgtacaagtgccacccctgctcttgtacaaccctgagagtgagggccttcttaaattttgggcctaggtgcttgcttccttctctcacccttgtcccagcccactctcctctctgctgatgcatccactctttctccatttgcaaaggccagattgctcttcggctttctgctcaagggttgcctcctccaggagcccacccaggctatcctgggcacatggagatgttttccttggccactcaaagagttccactgattccctactggggatgattgccaatgaagagcaggagaacacaatgtattatttgtaggaatctaatcctgtctacgttcattatttactgtacctgattctgtttccatcatgtgggcttagtcatctgcagttaatcctttgtttttatgaagtccttaaagaacccctgagacttgtggtgaaagagggacatctgcctccggtgaaccccaacagatagttaaattagagcccagaggggtcagctggggctgcccctgcctctggatcctgcgtaataaaaggaaacagttacaggatgcttcctgtgagccaggagcccggctgagtgcttcccacacatgagct

SEQ ID NO: 15973 - DNA, 1106 bp, Homo sapiens
ggcagatccggaacttgaaaggaatttgctatctcagtttggtaactcctcagatgctgccactcagaagggtgttggtatcactgatgcatgtgacttcatgagggagagtggagacatggcacagagggagggagggagatgcggggtggaagagtagaggccctggcgttgcacatcaccaggacgctattcgcagtgtgctgacccttcctggctgcaggcccctccaccagctgagccctcgtgtgtcatttcagggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtc

SEQ ID NO: 15974 - DNA, 2231 bp, Homo sapiens
tggatcatcagatctttagcctagacagagtgtcgctggtaaataaaggagacacaggtaacccagagtggacagtgatttgcgtggggagacacagtggatctggggcctctgatactttgcttcctaaaacagcccccagttttcggcttgccctatgagatgatgttcatgtgcttccttgaaaccaggtggaaagaaaggggaagaattaattttctcattctgttgctgttgaacgtaatgtaatcttaatactgtagccttcctagaagcccttccctctttttcatgctgtaaagtcaaatatttgatatccttaacataaattttaaaaattaaggtcattaggaagcaaatgtctatttccaaagcaatgagcttgttgtgactgtgattttattcttctatagtatttttttcctcattttaactgagaggagaaaataatactcttttgcaatatccttaggttctccccttccccctggtgccccttctagtgtcttaagactttgtcttaacaagtataacattacattttgttgttaaaacctttcgaaactgtattcagtgattcttccaagtttatctgctctgcactatttcactaataaaccctggctaccacgtagcccttgatctccaagtagtttacctatgcaagacctgtgacactctgaattcacttctctttctttcagaaagtagtcataaatggagcttaattataaaggtaaaacttgtctccaaccagtttcattttggccatttctttttcaaaatgtcagctgttttcctccaagatttttcaccaaaacaatgatcataagtgctggaatatataatactttgcaggcataaaataacccagacatactctcatatttctttggtgtattttggttggtaaaacttaccagcattaaatgtaaaatataatgaggagttaattccttacctagaactatttcttccttttaagattcataagtaaccttttatttttacagagctacgtataacttccacattacagtcagggacctgaggtgtaacttactaagtgaaccccaaggttattttatcttgcaaaagaaacctaaaccaaactaagggccttacagtttatggttagactgaatcaaaagctataacctcaatttttccaaaaacagcttctgactgcaaaagcaagtcatacagttgttaggtatgaaatagcactgatcaggaaatgcatcttcgcagatggtatttccttcagaaaagacttttctacttttaatataaattaagccataacagtttcatgctgtggaaagagggtgaaaaggttcattttaagagattatataatatgaactttcacatttactgtgaaatgtctaactttgccagtgcttcagcaagtttttttggggggtgatggggaggggtagtattggttttagaggtttcaaatctgtgaactttggagaggggacagttgttggctctggtatttactagttttgtagtaacgttttgctagcctgactgacttttcttactggtttttatgcccacggtccgaggggactgttcttcttgttgggggtgtctgcggaatagcgtctcgtcttgtttgtataggcagtcaatgtgtgtgacatgtgtgtcctttcagtccggaagcccactgtgtgacaatggcgtggggtgtggctgggaggtggggtgctgaagcttgaagagcatttctttgctgattcataacagtatttcccatcttttgcctgcaggcagggaaagtgtacagtatttattttgtttctgttttactttaaatttgtaagtctttaagtagcttacattgattattataggggaggacaagtgacttgtttaaagttgtatttagtattctttccaatttctgtattttaaaatattgaaattaaaattgtattacttctgttttgatttttttagcacttagtgtattttttgctcattttgtttgaaagtataaatgttgaaaattgtataaaatgcgtccttgaaagaaaaagaatctgaattctatatccaattctgactttgttccctttttctgctgattgaatcatgggaaattatttaaaagtatgaaaaactgggttcagcgtctgctccttactacttctgaagacttcaatgtgaaaagtaattgtcttattttattagcagtattgctggggatgagtgat

SEQ ID NO: 15975 - DNA, 2575 bp, Homo sapiens
cgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgtctataaacaacccgtgtaaaccctgtctacactatgccaaaaccagtggaaagatgggtagagtcatcttatctcaggatgtcaaaaatctgggtttgactgattcccctaccttcccacacagtatattcttgtgatttttgcttttctgtagatcctgagtcggtgttacaatagtcatgtttttattttgggttaagaaatacgaggtgtaagagctataatttccttttcgtgttatatcatgatctgggttttcttttttcctttacgtttttcacagctcttgagtattttctatttttttctttagtcacaaaaattaaaattaaactttatttttatgaattaaaatgaaatttaatttatttttatgaattaaaattgtggccagtatccactgtgtccttaggctgagaagtactaatttggagtagcccgtgtgtggaattctaaagtgaaggtactgtggattcatttttagtagttttagccccttaataagtggctaagttagaaaactttcagcgaggtaatagaaccacttgaatagaatccatgtgtctttttctgaattggtgaaaattcggccactgatccagtgactcctggtcaaacgtcttataacattactggccataatgcatccctttatctcatggaaatggctgaactttgtggtagctgctgcgagtacctgggcttaacagtaatagagaacctcatttataccatacagacacagcaacttaggaagacagcactgatagcatttagctagttgtaaccaaatacaaatatgtaaaattgagaattatgattaacatatgcaactttagtaataggaatagatgataattttcctgtattgtttcaaataagtgactgttcagctgggatccattggattataatttacaatgtcacataatattatgcttttcaatattgatgagtgatgtaaacaatataaagttggcagtttgtagtagttcagtatcctagaaatacattgaacttcataagtatcagttcatttttaagcatacagaattgaagattctgactgaaatcataaactcagaggaaacaagcccatctttatcactaattacttagcttgaatacttttctatttttaaataatcctaattattgccttttcaattatagtctactgtatttatttatatgggatcaacaggtatttatcaaacatctactgtgtgcccagcactacctagtactgttggggaacatcaatttgcagttgtggtctctgcccttgaaggtatcttctccaggaaattagcagtattattttcacttctaagcaaacatgagcaaaagaggacctgttcattaaaaaacatgctgacttttttagtttcaactgagatatgccactgtagaagtgaaagtaatttcacaattaaagaaatgcttcaacttggtaattaatatggtcatacagggacttggtgtagcatgcaaggaagcagaagacctgggcttttgtcgaag

SEQ ID NO: 15976 - DNA, 1183 bp, Homo sapiens
tacacaggagcgtgagaatgtcacacaggcaggttcttatttaaattcctggtagctgagcccagcagcatgtggtgggtttgatttagtctgtacagcatttaactctttctatggatgaaagatgaaagtggataaaagttctcatagactgtatgggaaccagatagattgagaaattaactcatgtgttgtgcagttacagagctctaggtgccggtctgatttttccttatagaatctagaacttaactgacataattcctgggtactttcagacacatagccaaacacgtagccaggtgattcatttggtaaattccataaggtctgccctgccctggaatggcttctcagcaaggctgtctcagctaggctgggaaggaggtggctttcagttccggtttccaatcagtgacttccaagaactggttaagaagcaggaagaatagaaagagttagatggtttctgtgttgggctaaaaaaaaaacctctcagatacccagttcctacaatgcatgtctcctggcagccagacaaggaaggagagaaactgtgaagggtgccagggtgccaacaagagcactcgtgttcttggcagagctcagaatagcgttcacagctctcagtgattcatcatctgcaggcctgcccacccgtgatccaagtgactgaggacggggtgagtcaggcagctccctctcctcatcacccttcctccatggctcggttctgtgccctccctgggccctatgggctgcctagcagaggggaggccgatgttgcaggggatgctgccagtgaggaaagggtgcctgctctgggtctgtgccagggtgaagccttcgtggcttcttgaaggactcccggctcccctctgcgttaagccctaggcacgtttagagaagaggggaatcttcactgccagctctagggacgggtctgatggtggggcccgcttagccccagcgagctactcagtgctcctgcactgatctagacaccacccctcatcatcgtatctgcccctcttaaatctaatctgcattctgttctctttctttctcccactcttttctgtttattcttttctttcttcccttgctcagcaagaatgatatttatttaagacatcacagctgttaaatgtttgcctctggggataatttttcggccaggtgc

SEQ ID NO: 15977 - DNA, 1108 bp, Homo sapiens
gatgagctatttttgtaatctaccaataaccctgtcaagtacttaatgaacaagaagccactaaagagaggaatggcatctgtttgttaatgactatctggtgtatagttaagaacagctggtctcaggggaggggaatgggctcgacttatataatcccaaccccttctcccctccccacacagaccattctgccagtttgctgcattaatcgttttcaactctttaggtcataaacccttttgagaatctgaaagccacttaatgtctcccagattgaaatgcttatatgaaaaagtattcgcaattttctcattgggtgttcatgagccaaaacttgaagctcatcattggaccacaaagttagaaaccttggtcaagagaatcaagtgcctgtgattgagattctgcagaattcagtttcatcgctttctgtactgaccctcccattgcctgtctacacgaaccttctgcagcatcagaccagttagctcattactcactgcaaagggcagttgtgcattcatattcataccttcttgtcttgattgacacctctctttaatacccctgttttgctcccagcttcatgaatcttaattttctctcaaggcttggccaagcaccatctcatctgaggaacctttcccaaccagccatgctagtccttccttctctaccgtctctccttcccttggtggtaatgtcagtgttgcttatttggtgcttagctgtttctgtcttccctatttttgtatctaactccccagggagactgctgctgtttttttgcagtgcccagctcctcgcatggttggtgcggaataaatgtggagtgtgttgggaagggtgggaggaagattcaagagtggagtgtgggcagagcaggccaaggcaaagttcctccctgaccctgcacactgccccgccacctgctttactcaggacgctgcacgcctgcaattaatggccgcagactgtcggcgctgcccaggttctcggactacgtgggttttgagtgcattctcctctcctctggctcttggcagcctcgccagctctccctgagggctcagcggcagcgaacagtgagctcttttgctccagt

SEQ ID NO: 15978 - DNA, 2031 bp, Homo sapiens
aaaacatgacactctaacagaagtaaactgttgctgcatatttaatactattttctctttacagacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatgaatctccatttcgttacttaaatctatataccatgagcactgagatttagaatgtgatcggtgccctcatgtttcctgatactgagcgctcccgggtgagcccacgctgacccacagcattgctgggtcacgtgctccctcacctgaggtgctggggtggcttcatttccatctgttctgtgaaaacttgccctttcccactgtggaagactgtgc

SEQ ID NO: 15979 - DNA, 2556 bp, Homo sapiens
acagagacagaaagtgggaacatcaagcagataccgggtaactctcactgtttttttaaaggaggggaaattccaaggtatcagttgagtcctgcacatattggggtaggggaaggagaaggttaacgctcaggtctgggagcgaaagtgtagagtattaaaggaggaaacaaacctcagaaaactgggagggataggaaaggaagaaaaaatgtgtgttaaagctctagcctaaacgatttccatgaagtaaccagaggggaggaagtggtaaatggaaaccctaactaagaagtctggttcgtcatgccctctggtgtgctggacgttttgccttataaacaacaggatagaagatactgctcgacagtgccatccctatcatggccttgttttttacaggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaatgagctgtttttgaaatgtgccgatgtcaaagaataatgatgtttttctttcactgactcttcgatcggtcccttgtcggatattcgggaggataggtactttgagaaatgtgtgtgagagagaaagggaaaccttaactagccggggtcatcaaacaatcctatacttgaaaatgttcaagactaacgctgggccacctgttgagcaaaaggcactggcagttttctgctaccatgcacttgcggttgaacttgcttcatgcccttagataacgggggaaggtcataatataattgtattttgaaagcttattgttctgcataattatttcgtgaatttttaaggagttttcattattgtgaattttttgtgagtaagaaccattctgctactcccatggaagaccttcaggtgaccttttttccacacttgtaaaaataactgctcctcgatttt

SEQ ID NO: 15980 - DNA, 1536 bp, Homo sapiens
tgttcttggcagcattatttataatagccccaaagtgggctaatctaacctaacctaagtgtgcatcagtctatcaagctgagtagttgaaaaatctcgatgaagttgtttttctttaaaggcataagagagtttacgtgcctgtcacccttattttccgacaggttttaactagggtcttaacctcatgtagaaaccagaaataacaaacagtatggaaaaccgtctttaatgtagttgagctccaggtttggggtagagaaaattgggtaatttttcagttcccgaagttgagtcctcatagtttgattttctagtattgttaagtaccaccgcaaaaacaaacaaacaaaaaaaaaacaccacacctgtgtttacttgtcagcaaagctaattttcgtgtcagcttgggaacattgttttttcagttgactatttgattctttgactgtgaatcattaactgttgctcaagtttttcagggttcaatgactggattccacttgttctctctccaccttctctagtcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaaggagtctgtgtgaaatgtcttcttttgtttttgttttttacctaagttatatttttcaaaaaaaaaaaaaaagaactggctagcccttgagttggatttataaaggaggttgccttgcttgaaagaaatggtcagttgtgtgacagtatgtggaaccctttcaggaaatgcccacgtgcctttcagttaagtctttaagtctggaggcgacacaccagggtgtgtccttgaagagtgggcctgtaaaaggggaatttgcattgcagcctgttcattgtttcccaggtcctgcccagaatgccggatcacatctaactttgtcattcca

SEQ ID NO: 15981 - DNA, 1879 bp, Homo sapiens
acccaggaggcagagtttgcagtgagctgagatcacgccactgcactccagcctggatgacagagcaagactccatctcaaaaaaaaaaaaaaaaagaaaagaaaaaggtatatatgaagttaggcagtgagtgcttactttttttttttttttttttttgagacggagtctcactctgtcgcccaggctggagtacagtggcatgatctcggctcaccacaacctctgtctcctgggttcaagtgattctcctacctcagcctcccgagtagttgggattacaggtgcgccaccatgcccagctaatttttgcgtttttggtagtgacgggttttcaccacattggccaggctggtctcgaactcccaacctctctggtgatccacccacctcagcttcccaaactgttgggattacaggcttgagccaccacgactggccgactgcttacttttgaattttttcttagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtagtaagtattctgaagaagaaaataagagttagagggctggatagcagttcatccatttgcttagttttgacaactttcccctttctgcttctattccttttttagtttaatcttagtacagtactttaatttggattacctaagatttacagatagagtgaaggaaatttttaatcccagtgaaatgaattcagaatgttttgaaaaactgaatcctttcgagtactttttgaaattaaatttcagttacccaagacatagataaagaagcaattttttttttttacaagtctaatcttggaaataacagcggtagaaaaaattcctttctttcaagtgaagaagttagttcagtagactgttttggtatttcattgcagttttattttcattttttgcggttagattctcagttctcttatagttcatgccttatctatttggacctttaccaccctcttacacattttcagctgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaagtaagtctttagggagatgtgtgtgttattagatgtgagaatcattatttgccctttcacagcattgtgggtttatttcagagaaacatttgatgaattgaatggttatcagtgagtagggaagttttcctttcttgggcttcttggatgctttatcaagaagtcatatttccagtgaacaaaattaactgggcatggaggcatgtgtctatagtcccagctacttgttaggctgaggcaagaggatcgctcaagcccaggaggttgaggcaaaagaaaaaaagaagtcctacttccagaaactcagactatagacttctaacatttttttcctcttttaaaaaataatgtttctgagattcacattgaatatgtttaatcttttgaaaatgcacatttcattggtttttagtatatttacagagatgtgcaaccattaccattttactaattttaggataatttgatcatcctacacc

SEQ ID NO: 15982 - DNA, 1250 bp, Homo sapiens
cgtgcctgcagtcccagctactcaggaggccgaggtgggagaattgcttgaacctgaacctgggaggcagaggttgcagtaagcccaaatcacgccactgcaccccagcctgggcaacagagtgagactccgtctcaaaaaaattaaaaatataaataaataaataaataataaataaaaaccttacaagagtatagatcacaaaaaaaggtcagggcgggagagtgcagggcgtgcagctcacatgtggaaacgcacttgtaaaaattatccaggacgttaaactcatccctgtagctgtgcctgcaagcctctcgcataggctctaagtgcctggtgtggcctgtgctgagaccatcatgtgctccaccggatccacatccacgtgtgtcctttcctagtcatcctgtctctgggaggagccttctcccctggaggcttcctcgggccctcgctgagtcggcctctctccctgttctctccccggctgcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtgagctcccactcagccctgtccccctccctgcagggtgcggagaacagagcggggcgctggctctgcaggcatcatggagcggttctcagagccagcagtgttggggagcagggcgtgggggcaccagggctttgtctggcatgggtcctgcccagaggctgactcagtcagaccctcagtgactgcaaacactgttttcccttccaaatgaaatgcctggtatgagcacctcttgagaaggtcagcaatgaacaatttagccagatgtcaaaactcttaagtcattaatagccctctcctctcccctgccctctcgcccactcccccacattgaggagctagcaagatctggtccgttgtcatatccgttacaaatgtttttaatccccaagttctgggtgtccagtttagcatcgaagcggggaaagtcctgcttggcacttctggagttacttagccccagccccttcctctaaatggttttgacccggaggactggggacttccagcagtcagagaaggaagcttaaataatgttgctcagccctgaagctccaggaggaacgcctgtccctc

SEQ ID NO: 15983 - DNA, 1104 bp, Homo sapiens
tagagggctacaaaccactgtaatatctaagttttttcattcctcccaaaaaccagttcttacccccttggggttatattaccttcattgagaatgcatgtattagtacaacctgtcacatggccaaaccctaggtcaaaggggcaaggaagtggacttcactcctgagtaggagctgcaacattgcatggcaaagggtgtggacacacagaggagagaagaattggggacaatcatgtgtagggtcaaagggcctgttttggcctcatggggaaagcagggcttccccataattcttgagtcaccatggcaggcccacttcacctagaactgagctccaccttggtgctttggcttcggaatagctaagctgcttttctgacccttgcagatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgagttgtcagactccttccttctccctggggaggcagtggcccagacagccgagtctccgtgctcagaggggctgcctttcagtgagcagtccaattccttggtgtcttctccccacccctagagctggcccagatcactcatcatgagttccaccctcaatccatccagcctaggactctgcccaatgcggcaagcccaagaactatgctatggcagctggggtgttcctttgcatgatgttggcctcaggttagggatctgcactgaacatccttaatttcttttaatagcccgttttctttcatacattttattgaaacctatttacatttcaagtctgtatcacctctataactttattttttgtttttgtttttgagacaaagtcttgcactgtcgcccaggctggagtgcagtggtgtgatctcggctcactgcaacctctgcctcccaggttcaagctattctgttgcctcagcctcccaagtagctgagactacaggtgcctgctgccacacccggctaatttttgtatttttagtacagacggagtttcaccatgttggcc

SEQ ID NO: 15984 - DNA, 1104 bp, Homo sapiens
cctgatgttatgaataaagttctatggaaacacagccaggtgcattcatttacgtattatctacagctgcttttatactacaaggacacagtttagtagttttaacagagaggatatggcccacaaagccttaagtacaatctggctttttagaaaaggtttgctggctgggcgcggtggatcacgcctataatcccagcactttgggaggccacagtaggcagatcacctaaggtcaggagtttgagaccagcctggccaatatggcaaaaccccgtctctactaaaaatacaaaaattagccaggcgtggtggcactcgcctgtaatcccagctactcgggaggctgaggcaggagaatcacttgaacccgcgaggtggaggttgcagttagccgagattgtgccactgcactccagcctgggcaacagagcgagactccatctcaaaaaaaaaaaaaaaagaaaaagttttctgatccctaagtccaagattcatatcctcactttcaaaggccttcaatagacaattagatgtcttcattgctgtatcatctcttccatctgtttcactgtgcttactctaaggcttgaagactcttttgatctaatttactctccctcaccactattctcagatagtactgtgtcattgctaatactctcacccacagctaagtcttcccattctatcaaataaatatctactgaaatcccaccgcatcatgaaagctccctgaacatttggtggcttatttggggtgccctggaacacatcaggatcccctttctccagcagggtgaccactcagagatgcagcccacacattcttcagaaagctgtgtgttgtgtttccattccttctctggtttctttcttctctgaccttttcataggtcatatctcctttgaatgaacaccatcacaatctacatctctaacaaaagcagaacctacgttttcccaacagtttgacaggagattccagtgcaatggtaggagcatttccttggattttattgtagatggaatttggcctcaaagaaggcttgcccctcttccttctttttgtgctcttatggtgcccaatccaggtcagctctt

SEQ ID NO: 15985 - DNA, 1437 bp, Homo sapiens
gattacaggcatgagccactgcaccctgcccacaaagtgaatttttttttttaataggaatttcaatgtttgtggtttgtgacttgcatataacatttatatctaagttctagcaaatctctatgaccagccaagaacaataagaatcactcacctggtgtttgtctttcttgtgcagggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacaggtaggtgccggtgtggccaggcagagtgtcgccacctgactctctcagtggtttgtgtcccatcataaccgtctgttctcagctgaattatttgttttattaaactgatggatcttgta

SEQ ID NO: 15986 - DNA, 1236 bp, Homo sapiens
ctttaactcctgacctcaagtgatccgcccacctcagcctcccaaagtgttggattataggcgtgagccaccacacccggccttatttatttatttttacaagacagggtcctgctgtgtcacccaggctggagggcagtggcatgatcatagctctgtgtaaccttgaactcctgggctcaagtgaccctccttcgttggcctcccaaagtgctgggattataggtgtaaagccactgagaccggcccctttataatcttttaaaaatgctttttactttgaaaataatttttctcttgaaaactttaacttagctcatccttgtacaaattctgagttgacatctaaacaagaagggtctataggacatgcacctctttgcggctgtgatagagtgctgggagcttattgtcacctggcaactttctttctctgtaggttggtggtgctctaggggcgactcactcatgagcattgtgatctccttccagatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcaggtgagacgcactgggaccacagaagttggggtgaattttttttaattaaaagagctggtgaagcatggtggctcagacctgtaatcccagcactttggaagcctgagcggggaggattgcttgagcccaggagttcaaggccagcctgagcaacatagtgagaccctgtctctataaaaaataagaaaataggccaggcacagtggttcacgcctgtaatctcagcactttgggaggccaaggcgggtggatcacctgaggtcaggggttcgagaccagcctggccaacacggtgaaatcctgtctctactaaaaatataaaattagccaggcatggtggtgtgtacctgtaatcccagttacttgggaggctgaggcaggagaattcattgaacctggggggcataggtcgcagtgagctgagattgtgccacttcactccagcctgggtgaaagagtgagactccatttcaaaaaaaaaaaagaaaaagc

SEQ ID NO: 15987 - DNA, 1132 bp, Homo sapiens
acatttactatttgaggtgcccctgcctcactgtaggtcagctgtccggagtatgtacagtatgtatagctgttaggcctgagatgatgatgatgcagccagataagcccttagatcaggattggagatgaggaagtccacctgaggcttctccatttcacagcagtaatgttaggagagttggaaacatattttgccaggactttgccaggatgtcaggaacctttgaaacctattgcctccacttccccctaccctccctctatcacagacacgtaccattggcttaggctggtacctccaaatggggaggcttttaaaattcagaccagagcccatataatgaacaaactaaagaacaggtgggccatcgaataattaaagtagaatttgttcctgtggtcaggggctgagccatattgtttttttttttttctttccaagatttatttaacaatttaattagttgcacagaatgtaaattcttgacttttctttcttttaaatggttgtcaccagggtcactttccgtatcctgatccttcccagtggacagatgaagaattaggtatccctcctgatgatgaagactgaaggtgtagactcagcctcactctgtacaagtgggtgtgctccaaatttctttatgtcatatttaccttttttcataaacattagtttttactttgtgcctatgatggacttgaaaaaactgcatattctaacagcatgaagttgagttaaccatgtcctgtatctgcttttttttttttttttgagacagagtcttgctctgtcgcccagactggagtgcagtggcgtgatctgggctcactgcaacctctgccttccaggttcaagtgattctccttcctcagcctcctgagtagctgggattataggcacatgctaccacacttggctaatttttgtatttttagtagaggcagagttttgccacgttggccaggctggtctcgaacttctgacctcaagtgatctgcccacctcagactcccaaagtgctaggattacaggtgtgagccaccacgcctggccatgtatctgatttctgccttaagttttcacatttgctttggtctcttcttccttttcattgtatgttttattt

SEQ ID NO: 15988 - DNA, 1188 bp, Homo sapiens
aatttttgttaattgtggaaagggtaattaacagttcctatcaggtatttttaatgtggaaaaggacagaaacccaactcctaaaatcttaaattaaggtaacagtgctttaaaaaaaaaaaatgcatggggcaattagtcggcaactcaatgagtgactaaagtacttttatttaacatccacaacttcaactgttaagttttattaattactaaatcagctttattaaaatgttgacatttatttagctattttgaataattatagtgacttgacgagtgtgtatgaggacacagccaatgtaagccagtgtatccattttttagaggtgcatttttttttaaagaattctgtagatagaagtgctctgaaaacaactaaaatatgtttattcatggtagtatcaaaaaatgtttgtacaaaccatctgcttctcccggccagccgagttcattctccagcaccgtgaccgctggttctcatgtacagcacatatgcgggagagttggcagaaaatttgtgaagagatgccgcaaaggaagggtctgttgacgggtgggattgggggttttgatgaagttgcttagtcctggttttgttttgaaaattactgcgttgcatttttgtgttaagtttttgaacccacgtgtgttttggtggagtatgagttggaagtcactgcaaactagcataaacaacaaagctcacagagtaggcacagatgtagagaacagagaccaaaatggggtgaggtggcagtaaatctaggatagggaaaaattaatgtgagggtgggaaataaactgtaattacctgaaatcaaatgtaagagtgcaataagtatgctttttattctaagctgtgaacggtttttttaagaatcattccttcctaatacatttgtgtatgttccatagctgattaaaaccagctatatcaacatataatgcctttttattcatgttaatgaccaacgtaagtggctagcctttatgtcttatttatcttcatgttatgttagtttacatacaggggtgtatgtctctgtgctgtccccttctcctgccttcattttaaaatgcatccatgggtcctccgtgtttcctttggccatgccacatatatagactcagtttggccttcatgatatcgcctgatttttgaggactgtatcacagtgatatgta

SEQ ID NO: 15989 - DNA, 1588 bp, Homo sapiens
gatcatttgttgttaatgtgcaccttaaaagaagattctgtctagctgtcaaattctggttcccgaatatctcacccctgattgtatttgagatctagtagggcatactggggcattttagaagataaaatcccatacaaatgatatatgctatatttatgttggtgttggagaagaaagagcagtatataaagaaataattcaagactgcagcactgtcaacctgaaactttgtaaatatttcctagcttctggtttggtgcggtgacagcactttcatcacaggatgttaccttgtattcaccaggcggagtgcgagctgctgcacatcctcctcagatctcacctgtccccactgtacatccacccgccagctgcttgcaaacctcatctctagctttagttcgaaaccacattgcagggttcaggtgacctctacaaaaaactacctcttcagaatgaggtaatgaatagttatttattttaaaatatgaaaagtcaggagctctagaacatgacgatgatttaagattttaacttttttgtgtacttgtatttgagcactctcattttgtcctaaagggcattatacatttaagcagtaatactgtaaaaaaatgtgttgctcggaatatctgaatgttgttgaaagtggtgccagaaccggtttaggggtacgtttcagaatcttaaccttgagtcaattgcatgaaattaaatagctgtggtatcacttcactaacagtgatgtaattttaattttcagtaggcttggcatgacagtacatcctcataatgagtttgctgcagctttgtcacatgcacaggcattcatagaaagaccacccagctaagagggtagaatgattactctttttgcaagattctcttctttgtccaagttggcattgttagtgctaggaataccagcaccttgagacgagcagattccaaccattaggctataaacaccatagccagagatggaaggtttactgtgagtatgaacagcaaatagcttacaggtcatgagttgaaatggtgtaggtgaggctctagaaaaataccttgacaatttgccaaatgatcttactgtgccttcatgatgcaataaaaaagctaacattttagcagaaatcagtgatttgtgaagagagcagccactctggtttaactcagctgtgttaataatttttagagtgcaatttagactgcataggtaaatgcactaaagagtttatagccaaaatcacatttaacaatgagaaaacacacaggtaaattttcagtgaacaaaattatttttttaaagcacataatccctagtatagtcagatatatttatcacatagagcaactaggttgcaaatatagttcagtgacatttctagagaaactttttctactcccataggctcttcaaagcatggaacttttatacaacagaaatgttgacagaaattgctgtagtttagggttgaagtactgtatgatgggcagcaatcatgtattaacttagaaggggaaattgaaatataggaccgaatttggttttatcagtttccagagtactgctgccaacctagac

SEQ ID NO: 15990 - DNA, 1261 bp, Homo sapiens
tgaagattaactggtaacacaaagattcttcatgaacaaattttagtaatgagctggaaagaatattgtactctgaaaactaaagacatagattaaacttctctcctgacagactatggccttactaattatatgttataataaacctagctatatcttatagagaaaataaatgttatttgcctctagtagataaagcaggatttttttattccaatacaaaatacagcttattgtcattaaataatgttactttttgttgttgttgatggtgttttcgttaatatgagatcatgaaagaatatttttccccaagggtagataccttatgtgctgcaagtacattttttttggaatgaaagaatacatgtgacatttaccaaataaatggacttttactgaaaactttgctcttttcttttttaggtgtttggcaatcaactcattcctcccaatgcacaagtgaagaaggccactgtttttctcaatcctgcagcttgcaaagggtagttccgtttgtgacttgttatatacttgctttttctaagggggaaagaaatcacagactatcaggcagctagtgagattgtgtggaattggaagaactaggtttagtactcttctagcaataagattcatttgtaatgtagaaataacagttaaatgagaaataactataaaactaatggatgcttagcaaacttgtctaattgaagtttaataatcattccatgattaacacctacaaagatgtcttatttgcttggaagtagtcccctcgggagcgactgctgtactgctaggacgtaaatccttaggccatctctgtccacaggatgttcagaaatggccaagaatactgtgggcttgggagatcagaaatgttctttccaaaagagatgatccttgagctagacctgggaggaagcaggcaggagaagactacccattcttctcagctgaggaaacagcccatgggacaggggcctggagacaggagtgacctagttatggctttgttatgacacaggacagcctttaactgaactggctggcctggaaatgtcatgtgggaattgtgggaattaaggtgtgaagaattgttgagacttgggtatataatgatttgatcatggcagttcattgattatacaaatgaaccacactaaaacgtggagaggctgtatgtgggggtggggagtgggtgtgtggagactcaaagtctgttaaggaaaaataaataggcaaaacttttttttac

SEQ ID NO: 15991 - DNA, 1118 bp, Homo sapiens
cattcagagcagtagaaaggtagaaaatatttaatttgcttataatacactcaggcccttggtttgagatattcttttggatggttcttgtgaaaatttgtgcaagcctctcaatttctattttaattcacaataagaagtgatttgtgttctatatgccatttggtggttctttttagtttaaagaatattgagcttggcctgtgcataactatacgtgttcctcattagctgcctttgtagctgaatataaaatgtctcttctataaaatatccttaaattcttgtataaagtatccttaaggtcaaaggatacagccttagtttaaaaataagacagaggactgagtaaatgtggatataaaagttaggtgtttgacattgattgaaagtactggatttttttttccttatgtaatagttgaaatatttgagtaaaaggtcaactaattggtatgttttaacattagtttgactttgagactatgccattggtggaagagattgttttgcaacttctgtgtccctggattcctagactgtgtttttgaattctgacctgaattggacaagagttcactgtcagaatgatatgcataatacttttgaaatatgcaaactctttgaaggctgttttttctcttcttataagacatcgtgttgtttccttttcctcagaatttacatgtctacatttggggcaggtttattcattcgtttgtgcattaattcatcagatacttagtaagtactttctaattgtgccatacataatcctagaggtcaggggattcaaggattaataagatttggtatttatttttagaacgcttccagtctagtcctgacaacagtcttggaagtctctaatcaccatacagtatgaaagtcactaacagagatgtgtataaggtactaggggagcacagagagggcatgactgtgcctgggagtttcagactagcttctggtgaattagtagtttggtctgctttgttatgttgtattcctagctcctccacctgtgtctatcacacagtaggtgctcaatgaatacttgagtgaatcaagcattgttgcctgaatggaaccatatctagtgttcgttcttcccctag

SEQ ID NO: 15992 - DNA, 1365 bp, Homo sapiens
agttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatgaacgtgcgtgc

SEQ ID NO: 15993 - DNA, 1270 bp, Homo sapiens
ctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaa

SEQ ID NO: 15994 - DNA, 1203 bp, Homo sapiens
ttaccaggttacttacgagaatagctgacttttagtaagcctttgctatgtgccaggcaatgtttaaagcacttacttttattcctggccaaagccatatgagacagatattacagaggaggaagaggagagaactgagttacagagagggacagtgacttgagcaagttcattctgttagtaaggtacaagccaggaattaaaaccaaggcagtctccgtggctcccctacttattttcaaacctgtttgtattgttggatgtttttgccctacaccgatgacatctctaacaggggactctatgaacttcctccttcaagggaaaaatccacattttgttgtgctttattaattgcatgggaattcaggtagaccttatttagattaatggtaagcttttagtgtggaatagttaggagagtttcaaaggataaatgtcccttgatagcaatttaaagttaagtttagctctttctccaagtataaggcaaatagcgatctctcagattattttccttatcatggatgattaacaaatggatgtagtcggagaaagcagtcgtatctgtttattgactcatcaaaatcaattatagctagattagcagggcaggattatatagatcattcactggattcattgatgataaaaaggacaccaagttgatatgtgaagaaacaaaattgcaggaagggcatatgcttcttaaatgacccactgttagaggtttcttttcagttatggaaatgttaagcaatcttttcatagaatcttccagggaactaaaatgacttggtgcaggaatgataagtggagaagagtttaaagttaatgcaaatgcatgatctaacttatgcaaacactgtggcaaagcacacagactaaggaacccaagttagcaagcacatcagctagcatcctgtttacatttctgtcctcagctctactcattaaaatcactaatccttgtcagtggaggatagtgtatttggatttttgcacatgttaaacgttcacacttacatttatacccacttttgcctttatttactcgttagcctttcaaatccaggaggtttaaataatatttttagactgggagacttctgttgttttgttttaatcagccagattctcttaacatgaagagaatttgcattttcctcgtaaaattggaatttctgagaagaatcagaaaag

SEQ ID NO: 15995 - DNA, 1115 bp, Homo sapiens
acaccaagctcacggccatctagttgcccaggtctcagttcccaggcctgtgggtttctagagtgtaagcctggataaaatcccatcctggtcctccatttccaggagaggactggaagctcctgggttccccaatgttgtctgcccagtttcagctgtactgctggggggagggagggtatgggtcacagccatggccctcaggtgggagtggaaggcagggcattgggggaggaaactagttgttggcctcgccttcctcctcatcaaaggactgcacacctgaggatgtgacgtcagacaccttccggctgagagcggtagacatctcagggtcttctcgtggggaaagtgactccaggtcccggcatcccgcatcctcttcctcctcaggtgccaatggcctcttctcctcctcagcagggccccttgccaggtccactgcgcctacccccggagcccagtcagtgtctccccccagcaaaggtggaggctccagagcagagtatcctgaagctggttgggaaggtcccatttcatgcaagctgggttgtgagtcatcaaatgcaggcccaagataggatcctgtggccggagaggcaatgagggactgatcgctggcttcccaggcatctgacgaccccagacagtacataccctgggacacgtaagagtgaggccatccatccatgggtgcttgagccagggcatctggaaaaagaatcatggaggtcagtggggccacagaatgtcaagggcaggaatgacagcacagacagcacaagagacagctaagagacagcacagagaactggcagtaagacacagagtgcacagtgagtagggaggacaatgggaaagctgagatggacaaggaagtcttaaaagaacggagctgagtggaggcagctgagatagttggggaggcctcataggctccagagtttggattctggaacatctctcaccctgactgtccatcagttcctggtagttgtcactgtagttgcagcccaatggctcctgggtggagttcacactcatgtcctcaccatccatggaagaccaggccatgagtgtggcctcagagatagcaaactgctccatgacgcctg

SEQ ID NO: 15996 - DNA, 1369 bp, Homo sapiens
ttcccttattttcttacagcaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgcgttctcatcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtattcacctttcttttgtaaagagaccatcttctatcttctttccacctttctctgttttatgaaaccaactgttgacatacaaaccatgattgaaggagaacctgtccaacatgttttatgtacacaaat

SEQ ID NO: 15997 - DNA, 1177 bp, Homo sapiens
ttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaa

SEQ ID NO: 15998 - DNA, 1215 bp, Homo sapiens
tttgcattcttgctgagttctaagtgaagagctactaaaagtcataggtaacccgtgagattgtatgatttttcctatttattagctgtttgtgttcctgggaatttcctgagcatatcctttgcccttttttctttgagtttgtctttctaattgtcatctaggtcaagtgatatatatttttgataacttccgaaggcaaaggaaggcaacatagttgtgcttgtgcaaacttttacccaggttttctcttgagtgctgatatcataatgattttgaactaaaattctaagcgtatttttgtacacagaccatatggttaacatgaatgtgtttgcacatagaaagagaaatggtctctagagtgggccctgcagactgagtttttctgtcagtgtgtctcaccttattacagtaccccagagacaatccactgattctctttatttcttcctcaggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacacgtatcctcctgcctagcgcaggttgattgcttagagttttgattatttactagtatgacttatgaattattagaattttatattgttttctcctcccagttcatcatgtaaaataatcgcagggttcatttttagccttaagtttttgaacagagtagaactggttcatttttagtcaaatgcagcactgggcagtacagtcaccactgggcacatgtggctgtttacatttgaaatattttaaagttccttaggcacactagctgtgtgattaataaataaaacatttctgtcatgtagaaggttccgttgggcaaagctggtctaaagcaaggtcctgaggttctcagcagatcatttgttttacgtccatttgtttatatattgtctatgactgccttgtgttatgggaacagagttaagtagttgtgtcagaaacagttttgtccatgaagc

SEQ ID NO: 15999 - DNA, 1122 bp, Homo sapiens
tctgagtcattttaaaataaagtttgtgttatttcaatatttagaatctgtgcctctgaaaaagttacagctgagcatcataatagacagtgcttattgttagctttttgtttttcctggagtcagtaattgcatttttcttttgggacagttttccacaaggtcagtcacatcagataatctaaaaggtccagatttttttataggcaacctccctcctggaatgttcccttctccaccttggcggtgttgctctcaaggcctaccaacaaccttgtgaatggggcttgttgacttttagctttatggatagtgtgaatgggatctttgttccattctagtttttaacaggttttggttgatatattgggaatgcattggtaatgaaatataagaaaatatgtttatgttaatgaccgttaacgtctgtgatatatgttggtttccttaacttttctccaagtcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggtaagatgttttatatatatactgagtattcataacaggatataaaaaaagtgaaataatggttctaacttgttaaatctttcactgtcatctgttactgttttagacactaacgtaggtgacagtgttttgctattgcatagtcttttacctactgtgaatatgaaatcaccataaactatattctagggttttgttttttcgagatggagatctcactatgttgcccaggctggatttttgatctcctgggctcaagtgatccttccacttcggcctcctgagtagctgagactctgcaaatgctcaccaccgtgcccagctctttctgttttttaaaattagaaagctttgataaccttttagcataatagtgctttcgttaaattaccaaccattttggatttggttgttagaaatgatgaactttttcatttaaagcaaatatgtattcaaattatctgcattttactgtgaacccaat

SEQ ID NO: 16000 - DNA, 1164 bp, Homo sapiens
aaatgtaagcactggtcaagaaatgattggaaataatattaagaagtacaattcagggtgtgcttaagaaaaaagcgaaaagatgaggacaactcaaatccaatcggcaaaacactaacccatcgtagttcacattttccaacaaaactactcacagaacgtcaagaatattaaaccaaatgatccaaatttcattattccctacctgagaaagatcgaaaaaagaaaatggcacaaagaatgagaataaagtgcatcatcagctttcaaacaaccaagcagggcaaacaccacaagctagggtacgggtgcaggcaggaaacagaaacaacacagctacacattcttgagataactctggtctttatactgaaactaaccaactaagaaaattattcaatgcattatacatccttaatcctcacaacacgaactttcacagaacagtaaaacccagttattagacgtgtcttaccagaggagctcgaagtttcatctttcttctcttcttcttctttatcattgttctctccccccgtttcagtccctgcttccctatcactgtctgtatcctttgattccagcacattaatggtgggggtgctgggcctgctactgttattgggaagccgtcctcttctgcggcctcctggacgttttggtggggtctttatccgctcagcggtgagagcagcagcaaactcctttgctccctcctacgaaatgaaaaatgtcaacatcagggcaaagttctaaaactcattttgatggaagagaaaaaaaaatactatataagccaggttagtcaaaaaatgtatcacattatccatttatcacaaataatcatttgcatgtctaatatacttgttttgatatgcttttgatagtctgaaaatttcagaaagagaaatatgggttctatatattcctagaatggtacaaaaatcaggcaagacagttctatattgtgaatttgtaaaatatattagctagttataattaagttaaaatataagaagataaagtatgaaatatacttcatgtaataaaggtaattatctctatggacatacagtctatttaaaagtgaatctttacaaaagaatcatatacctaatgtgcacggagtcagactacctatgcagagtttaagataatgcatac

SEQ ID NO: 16001 - DNA, 1159 bp, Homo sapiens
ttttattatatggtgaactgtatgttttctacttttagtactgtttgtaaattttacttcttcttggatttacctttttcagttatattattccattatgccttgctactgtaacagctaatgatgaaaaacaggatctgtctttatattttcttccctccacaaatgtggatctcatagagttgaaaactaggttgtgatatagtatagtatacctaattcctgtaatgggatcatgttcctataatatggccgcaatttagtgtagaatttttgtaaataaaagtgtattttaagtttaacttaaactttcaatgaagtgttttaaggatttaaccatgcagcacaaatgagcacctttctgtaaatgccaacagtgtaatatgtgtcatttcttcactgattgttagtttgctgcggattaaaacacaggtgatcatattcaggctggttagattagtgattttaatatgaaaccattgcttttagaataatcatgggccagactgggaagaaatctgagaagggaccagtttgttggcggaagcgtgtaaaatcagagtacatgcgactgagacagctcaagaggttcagacgagctgatgaagtaaaggtataattttatcttttgtgaaaatgaatatacaattaaggataggttttttcccctcctaagttcaataagtttttatttaaaataattctagccaagtttgtatttacaataagatgagtgaatacttggaagcttaggttcttgatctgtcttaacattataccatgcacattaatcagtctttgtttagtatacttttatttgcatatgcagctgcagaaatgcctccctaaatataaagggatgcatttcatgattttatgtttctaaagtcattgtgattaaaaaaaaaaatacacacacacacacacacacacacacacacacacacacacacacagtcaacaaagaaaggatggcaatcgtttcctgttctctaaccacttgcaataaaataacagatgtggtgtttttgtattatttgaatgtgggaaactatagtgtaaaatctatatgcacctaagaaaatgttcttgatatttttgaggatacactagatttttaacctgctttacaggtgttatacattttctaacaatgaac

SEQ ID NO: 16002 - DNA, 1175 bp, Homo sapiens
cccttgggctcacaggcccacccaccacttgctggctgcgcagccttgggcaggtggctgaccttgctctgcccacccctggagggcgatgtctgtgagggactccagtcgttgtgaagtgtgagccctcaggacctcctgcgtgaagaccgcacaagctgaaggtggaaagttccacacagcccagcccgtgataacccttcctgtctgccaagagccaggcctaccttgagtggtctctttgtggggttagtgagcctacacccccaaggaaagggccaaggtgtttgccttttcccaagaagccacctacggttcactggagggaaaggagccccaaaagacggtagggaatgactgggctgtgcttgagtggggtcgagccctggggtgttttgcctcctaagactgatccccttcaaagtcgccactcccccaaagtccctcaaacattgtactcaagaacaatggtggggagatggtgggccccctcacctgttccctctttgaagcagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctggtgagggacccccaccaagacctgcgggggtggggggtggggggactcgttctttcaggcaaggtggagtgttgaggggaggtgtggctgtatgtacatggctcactcagaaatcccagcctggggcccttgcacgttggtggctcaggtatattttttaattgatggcttccctttttagcaggatgggagcttagattcaggtgcagaaccctcttagagttgacgtagctgagacttggaggagttcagaggctgcagagctgggactagaccagccctggccccaggcaggcgtggccgtgccacctgggcacaggtcttaagggcctgttgggcttgcagctgtggcccccgtgacaagtggggcttttccagaaacatgtttccctccaattgaggtaaatccagggtttgagcattgtcagaatattagcgacaggacctgaagcctgacctcagagtctgagctgggacttgctctgtgtggccgcctggcttat

SEQ ID NO: 16003 - DNA, 1177 bp, Homo sapiens
tctcaggtaatgccactgcaccttgagcaatgggagctactgctcctcttttaaatttttcctttttttttttttttttttgcatacatcttatgacgtatgtaatatagtaacattagatgtgaatgactaaatatgtatatattttgtatgtgttcaggagatgccccacaatgctatccataggcatatgtaatcaaaaccattgggagttggtgagggtttgcgtggagttagtaccatagcctgatggtaaaggaagtctcaaccatcagtaagtcttaggccctctggagaagtctgcaggctgtggaaatgcgatggacaattgttgggaaatagcgaaccttctgactcttggctgtgtccccaaaactgcagagatgcagccaggtttcaggaaatcagacacctcctgttcttgtgggccccgacacttgctttcttccccctcctcatctgcttctggagggaggtgaagtgcctgccagtttgggccttgtgtgctcagtcttgcttggtttctttcagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtaaggtggtgtcaggccctttccatattcagtaccctggtgggcactaggtgcggggtggcaggcccctgcccgtgaggcaggaacagcagaggagcaaggtgggcacgagttgtaggccaggattgaggctccaggtcttctggaagaagcgtggatgtaagagagctgttgggggagtgaatgtggaaggaactgccaagtagtccattcttgggtgggagaagggacccaaaggaaagaagatggcagaaagagaggtggtcggagtgggagcaagtacagtggctggtctgagctgcccagcttggggaactgaggtggctgcttcatggggaggggaggggagggacgcacaaccagttgcgtggataagctggcagcagtcagagtagagagcagagcggaagaagacggctctcaagggagaggggagcctggcttcaggagagaccatctgccttcccaggagacggcccagggtaccatctgtcttggtgattttgt

SEQ ID NO: 16004 - DNA, 1199 bp, Homo sapiens
agagcttccgccggaagctgtgtctgctgcgccatctggcggcccacacggggaggggccccttccggaacgctgacggtgaaatgtgcttccgacacgagctgacccatcccagccaccgcctcccgcagcagggggagaagcctgcccagtgcaccccatgcggcaagcgctccctcccagtggacagcacgcaggctcgccggtgccagcacagccgggaggggccggcctcttggagagaaggccgcggggcctccagcagtgtgcactcgggacagaaaccaggctcgcgcctgccccaggaggggaacagccaccaggaaggggacacggaggcgctgcagcatggcgcagaggggccctgctcctgctcggagtgtggcgagcgctcccctatgagcgccaggctcgccagcccctgcagggcgcatactggagaaaagcccttccagtgtgcgcattgcaccaagcgcttccgcctgcgccgcctgctgcaggtccaccagcacgcgcacggtggggagagaccgttctcctgcaggaagtgtggcaagggcttcgccaagcagtgtaaactcacggagcacattcgagtccacagcggagagaagcctttccggtgtgccaagtgtggcaggaacttccgtcagaggggacagctgctgcggcaccagcggctgcacacggacgagaagccctttcagtgcccagagtgtgggctgagcttccgcctggagagcatgctgagagcccaccggctccggcacggtggggagaggccgttctcctgtagcgagtgtggcagaggcttcacccaccagtgcaagctccgtgagcacctgagagtgcacagcggggagaggcccttccagtgcctgaagtgcgacaagcgcttccgcctgaagggcatcctgaaggcccaccagcacacgcacagcaaggagaggccgttctcgtgcggggagtgtggcaagggcttcaccagacaatccaagctcacggagcacttgcgcgtgcacagcggggagagacccttccagtgcccagagtgcaacaggagcttccgcctgaaggggcagctgctcagccatcagcgcctgcacacgggagagaggcccttccagtgtccggagtgcgacaagcgctatcgcgtgaaggccgacatgaaggcccaccagctgctgcacagcggggag

SEQ ID NO: 16005 - DNA, 1130 bp, Homo sapiens
cagcaaacgcttccacggtgaaggcaacgggagattcaggtgcaaggtgcagcctagcaagacccctggccacacacgcatcactgcgggaggttggagggtcccctctaccgggctttccagggcttggcgcgtgctcggagcgtgcactcagcggccattgtgtgtttgatttttcccaagggcagggccggcttttgttcatttcgcgcttgctccagagtctggcgcaaggtcctcagaggtcctcagtgcacgcgaaatgaacggatgaacaagccacaggtgacaatgtgcgggaagaaacacgggtacaatcccaaatctctgcccagctgggatggagatgattttcttcattaaacctgatccaacacctttaaacgctatcacttaaaaatggattttatcattccttctgatatttcagccccaatattaggtagagtacccggatcactgccaaatcctcttaccaccgttgcaggtggctggtgtgcggcagaaatcctgctccacggccctgccctttgcagcaaggtcacccagctgcctgataaggagtccagggacgggcagcaagcgggactgcggggaaagcgccgggcacgccgcgtggcacccgaggcccgcccgcccttcctggctgggtatgaacaccagccgcgcccgcgggcggcgaccccgggcttcctctcgttcaggtcgcctggcgcggccgtgccttcctgcttccctacggcagcggcacaccgggaccttggggaaccgggaaggggcccttccccaagccaggcctctggcccatccaggtcccctcgagtccccccagctcacccagagctcagcgggtcccgtcctcggtctccccgccggcctcgcggctccattgctgccgcccgagaggccctacgcgagctcctaaaaccctgcgccctccatttggcgcctgtgggatggggcacaaccgtgtcggtctcactggtgctgtgagtgcagctgagagccaatggagcaaggacttaacacaaacgattatatttttattttaaagatgtatttatgcgtctctatccatattttaaatatgcacattttctcgattacattaattttgatgacttgacttt

SEQ ID NO: 16006 - DNA, 1170 bp, Homo sapiens
tcatttgcggttcataatagtggtataattgatgtctaaattggtgctgtggtctctagaagagattcacatatgaggggcacatattattgctaccaaacggaagcactttttatgtgtatacttgtctttgggttttattttgctagctggagactgtggcctttaatcctcttttcctttcttccatgaacacaggttcagcagctggacatggagaaccaacgctcatcacctctgtcgttccccagtgttccacaagaagaaaccttacgtcaggcccctgctggactcccccgagaaactctgttccaatcccgcgttcttcctcccaaagaaattccttctttgtctcccaccattccccgtcaaggctccctgccccaaacttccagtgctcccaagcaagagacttctggccggatgccacatgtgctccagaagggaccctcactcctgtgttctgccgcttctgagcaagagacttctctccagggccccctggcttcccaggaagggacccagtatccacccccagctgctgctgaacaagaagtctcccttctctcccactccccccaccaccaggaagcccccgttcactcccctgaagctcctgagaaagaccccctgaccctttccccaacagttcccgagactgacatggacccgctgctccagagcccggtttcccaaaaggacacccctttccagatctcttctgcagtccagaaggaacagccgctccccacggcagagatcacccgcttggctgtgtgggctgccgtccaagcagtggagaggaagctggaggcccaggccatgaggctactgaccctggaaggcaggacggggacaaatgaaaagaagatagccgactgcgagaagacagccgtggagttcgcgaaccatctggagagcaagtgggtcgtgttggggaccctgctgcaggagtatgggctgctgcagaggcggctggagaacatggagaacctgctgaaaaacagaaatttctggatcctgcggctgccccccggcagcaatggagaagttcccaaggtaagcacatcccaactggggcttcccaaggaagtgatctgaattggagtgtggtttaggaatgtagtgtaatatgaaagaaaggggtggttgataaaggaaaaaatacag

SEQ ID NO: 16007 - DNA, 1159 bp, Homo sapiens
gtgggcctagcgcaccaagcccctgggcagtgagggccattgggtcccttggagcacacctcagtgcagcaggaaggacccctccgggagtagcggttgcatttcccagcttgcctctcctgaaaaggccccccaaaagtgctggccccaacttttctctattttgggccatctgtggtacccgtcccaagggcacttggtggtgtcccctagtgtgtgactccctggcctcataaggacgagttgtctgaaatcccagcgttaggtctggggagatggagaagctgaaactggggagctgcaccacaaacgtctagctctcagcagagctgggagcaaagcctggccgcccaccccaacctggggctgcctcccactccgtgagatgcttctgtctcctgttcactttgtgtggtagtttcttattttcaaaatgcatctcatttgatcattactgtgaccttgggaagcagcaggacagggatttctttttagaggtgcaaactgctcagaggggacacacctcagcctctcactgtgggtacacgtggcgtgccatgagtggggaagagcaacaggcgagatgcctcattctactggaacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatgtgtgcactctcagagggcacagctcgcgaggctgggtttgggggccaagtggcttgttcattccagcatctaacatcataaaggtgggcccagatttcttgattcgaccacagtgctgttcctaccacacaaatatccattcctgttttgttgaagcagccactggtcctcttgtttcccctgcagacggagggacctggcagtgcccattcattcagccccctcatgcatacttttattaggcgatagactagttaagaaaattgtttctatgtactgtatattttgtacctgtttacacttctaatattgatataactgatattttgaaaaataagagaaaacatcctgttaaaataaaacctaaccagcaccaaggcagtttgttgggttccattcctaggcatgtgtctttgtc

SEQ ID NO: 16008 - DNA, 1198 bp, Homo sapiens
cagatgtccccaagggctctgccacaaaggggaacagacaagcgggcagtggctgccggggtagaggtcaaggcaggattgcttgtattgcccttgagaagatggcatgaggtgggatctggtgccagatcgaagtggggctttggctggagggttgacagtttagcagtcacagaagtgaaggcagagaagggggcactggtgcaggcagatggcgtggagagggctgtgtgagtggtgcgtttctcttttaaaaaacgggttaaaatataaaactgttctcagctgtgcaccatacagaaacagatgagctaggtttggccctcagccacagtttgctggcccctgggctaaggagacacggtgtgactgtgtggcagagcgcccactgaagtcgctggtcatgaatgtcacgtgacaccagcagccagcttacctggttctctgcagccacgtgcagctgcttggctgcaggtgcagaacaccgatggatttcactaagtggatacaatgaacaaaacaggggcaagagtgctgagggtgtgtgtaaggggggaccacaatggtgggcatggagggaaatgaggatgagtcagggcagtgaaaaggcagcagggtcgatggcttgcaggtcttgaaggactggaaaactgctggaatcaggacaccagacggaattgaagggacggcaggaggcggccagggagtggtgtgctggagatggagatggtgggtatggtaaagtcactgtcgtcacagtcacggatggctgtgggatgggttgggggggcacaggacaatcaacaaggaggctgccatggccaagactgagggcaggaagagtgttgagaagagagggaaggtctgcagaagtagcaaaaagacaaggcctgggacccaaaggcaaggtctctagagagggattgaggctggcagaggcacaatctgaggggtgaggaccctgtcccagtgggcctgggctcaagacagaggcagggaagaggatgacaagcactcagagggctgcagtcccctggagctcagtccgagcagggaacactcaggacctggcgggtctgctgagccctgagtcccacaaggctcagtggagggatgtgcaggaggtgaggagaaggggaggtgaggtctcacaaggggatgggtcaggccaaatgtggcaagggatgagctgggagtc

SEQ ID NO: 16009 - DNA, 1170 bp, Homo sapiens
gtgtccatccattgggtttctccagtggagaagcttcttgagggggctcccgccgtccactgctgctgcttggtttaacttccagcagaattccttcctagatctgctgcagggcctgctgggatgcctttgctgaataaatgcggttttgctgaccctcccatcagacgaggatgggccctaactgagccccacccttgggctgctggcccctgtgagatactggggtgcagggatggcacctgcctggtgggagaagccgcctggcctgtgagacctaggcctggctagaacctgactgctaatggcttccaaggactggagacttccagaaagttccccagcagactttccaaagctgctggggtcctggccaggctctggcttcacttttgtcctctttctctggcaagagaggcagccatttagggtccactagaacgcatgctgatcgtgggctgagctgaaaaggggaccggttctgtgtgcccagacactaaggcagagacctggctctcttcaggctgatgacagagcactctctggtcccctgcccagggtctgcccccaagccctccccgctgcactgcctggagagcgccctgagggggatcttgcctgtaaggcccttgcgcttcgcctgcgtgggaggccccagccccagccccagccccggctccagctcgagcttcagcggctctgaaggagaagacccgaggccagagcctgatctctggaagccgctcccccagggtgagcctgtgcggagagggaggatagcgggatgtgtgccagggcgccagtcaccactctgatgccagctttgtttgtgacgttagagagggaccgccttcccagctgtaagcctcctgtccctctgtccccatgtcctggtgggacccctgctggcagcagtggcggcagccctggtgaagaccccaggagaacagagcccaggtactgcagcggcctcggtgcaggtgagcctggggtctcctgagggggcgcccatgcgttccccagaggaccaggagtccagactggatcctttgagtcctgcctgtcgctttgcctggctcttgccagggagtcctgcacattggccgtgctttagttccctgtaaggtgagctgtgtccgagaaggagggcggggctgctgggggtgctgg

SEQ ID NO: 16010 - DNA, 1200 bp, Homo sapiens
cagccgccatgccactgtgggaagcccctgcagcaggagctgcacagcctcggtgctgcccttgcggagaagctggatcggctcgccacagcgctggcaggcctggctcaggaagtggccaccatgaggacccaggtgaatcggctggggaggcgcccccaaggccctgggccaatgggccaagcttcctggatgtggaccctcccacggggacctcgctgggctcatggccctggtcacagacatctgccctactggaggcagaagggacccacgaggcctaaaccaaagatcctgcgtggccagggagagagctgcagggctggtgacctgcaaggactctccagagggaccgctcgccgggcacgtccgctgcctccagacgctcccccggcagaacctcctgggctccactgcagctcttcccagcagctgctgtcctctacacccagctgccatgctgcgccgcctgcacaccccctcctcgcacataccgggggccaccagagcccccttccccctttagtgcctgctgccttacccctgcagggagcctctcctcctgcagccagtgcagatgcagacgtgccgacctcaggagtggcaccagacgggatcccagagcggcccaaggagccgagcagcctgctgggaggagtgcagagggccctccaggaagaactgtggggtggggagcacagggacccgagatggggggcgcattgatggcattcctcttctccacatctgctcgttcttgccgagggtgcagtggtggcgtggaagccctgtcaccccaccccaggccaccctctcccagaggacgccatctcccttactgttgctgggagcctcgccctttgtcccaactgggtagagcccccaggtgctgtttgctcaggaggctgctgtgggggtgccttcctcagcctctggccctcttggctcagattcaatcaaatgttgcttccctctcctgtctttcccactggagccgcccaagcttgtaggtgggtggtgtgcataggccacgtgtgccccacatatgcagggggtgccccacacagctagagcggccaggagagcgcctcctaaccaccagccgttcctgatctcaggagccttgaagggctgggctcttgccttcctggagtaaatattggcacagatttcatttgagagaactcagccccctggtct

SEQ ID NO: 16011 - DNA, 1131 bp, Homo sapiens
ttttgaacctggcattgtatgaatgtactacccatttaaaagtaaaattataaatagaattatacataaaattaaatgatatgcttataggactctgatataggtgctttaaccacagtgcacagggatctgctttggagtgaaaactcactttgcacttgggatcagaactatgcagttagaactgacttatttgtagtttcatagattataactctgtctgtccaactagactctaagccccttgcggtagaagtatgtccttccccctgcagccaggaggcactgatgggaacgttaaaagtattcgtttaacctgtaggttgttggacattcagacagtgggggtgaaggaggtgggcttcttgcaaaaggggcttggcagtggcccagccaccctgctcagtgaagagggtgggatctggccctcccaccatcccaccctgcctaagatgggaaaggccaagggaggggaggaaactccatttggccctagttcacccgctccctctcgcccaggagccatacctgcagagccagtgtgactgctgcagctaccgtctagacccggagagccctgtgcggatcctgaacctgcgctgtctgggtggccacacagagcccgtggtgctgccggtcatccacagctgccagtgcagctcctgccagggtgggtctgggcagggaggggacggggcaggagcctgggcaaggacccagtgttgtgaaccagacccaggaacacacgtgtagctcctcactccatccttcttccttgagtccttccagtccacgtttttccttcttctcggtgttcttgttaatttcatctcctatcatgcatacttgtgggtgtctggggtagttgcacctagttcaaaccccagctcatctgtttcctttgtttccttgctcagcctccctgacatcatctttttttttttttttttttgtgatggggtctcactctgtcacccaggctggagtgcagtggtgtgatctcggctcactgcagcctggaactcctggtctcaggtgatccttccgcctcagcctcctgagtagccgggaccacaggtcacaggtgtgagccaccatgccgggctaatttttcttttccttttttttttt

SEQ ID NO: 16012 - DNA, 1241 bp, Homo sapiens
ttaactcccctccaggagtctggtgagaatagctcggaggttcctcctagagctgacatcataaggaatccagttcaacttcgtaaactctcatttttccaaaatccagaaaaacagcatagctcatttcttttcctgttcctgatattttttagtattagaagctaatgaaccgatgtaaccttttatcatctgaattcagcagtgaggcgtgtgtaaaccagtcactggtcataagcatctttagcttttttgaccacctctttgttcccatcccattgggaaatcttaggtgctcctagaggcacacagtcaccttttagttgtaggtgaccaggaggcagctctcaggactctgaggacagcatgcagtgagaggctctgcccagctgcctgttctttccacacgctttcatttccgcccaggagatcctaggatctgaccaagtctcacttggcttttacctactaattctggcctcctgaatttgattctttgactttcagtggataaattaattcctctgagtgcatctgggcctcttggtgagcttcccaggagaaatagggcttccaaaggccccagaagtgtcacgtgggagtctggctcggcaggcggtgctgagtggccgctgctctttgttccaggacccttctgcagaggggctgtcggaggaggttcctgtggtgtttgaggagctgccggtggtgttcgaggatgtggcagtgtatttcacccgggaggagtggggcatgctagacaagcggcagaaggagctgtacagagacgtgatgcggatgaactacgagctgttggcatccttgggtaaagacgcaccgagcctcttattcaccaccctcctttgacttgggaagcccacaaggggagctgtggcttgtggttatcttcccattcctgccccctccctgtgtgtaggcagagaccgatcctgtcttttgcacctcataactcccctgcttggggtaactgtgctttatcaccttctcatccacccacctgttcatccattcgtcccccaccaaacattttggagtacctactatgtgccagatgaacacagctgatccatggtctctgctttcaagggcctagcacgtttgtgggagagacagacattttaataagaaactataaaataatacagtctcccataaaagagcttccagaagagtacccggggctactgaagaagagggatttgatttcctgggcattggtg

SEQ ID NO: 16013 - DNA, 1896 bp, Homo sapiens
cgccagggatgaaatgggaaccatgctcccagcacccccctcccccatcctcacagcgcttcaccccaaggcaagaccctaacctgggccctaacctggacggagggagggaaagggtaagctgaggactatctgggcaggggtgagggggctttccagggagggttgggggcagtggagtctccactgcaaggccgggacccttccatgtgatgtgcttttcaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaagattactgtttggtgacaaagccctggcctctgcctgtgtgcaggtcccctgccccgcccacctgattcttgtttctccagtgggtgggtctggggaggggagcagggaaggattctgggagctgcagttatgaacacagatatccaggactactttcctgagatctggaggaaaatccggccccctgctgactgcccggattcggcggagaaccaggcctggcaggaagaccgaggacttgttcaagtgcagctttgagcaccactcgtctgggccccagaggacacagtgcaggactcctgcagtgaagc

SEQ ID NO: 16014 - DNA, 1210 bp, Homo sapiens
tgcccacctgactctcctcttggccctcctgtcctcccgtccatcctctgtccccgggttctcctgcccctttccctccccttcctcctcctccatggcctcttcgcctgcccatgctctgtgtgtattgcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctgaggagactccagtggtgctgggagggtgtaactgttacttgctgtgtcctgtgttcctgtctggacatgcataggtgtgcctgcacaggaatccgggtctgtctgcatgcccaggcccacagggctgcccctgtatccaggtctgggtgtgtgcagtgggggtgctccctgggggctgacacaggtcatctccagggagacagaatcttgtctctgtagggccctggattcaagataacaaaaaaccccctgaaccacatgcatttagaggcagtcctgatgggacactgacctggtgtctagcccctgagggccatgtgcctctgctgggtggggcaccctggctcccacagcttggcttcacactgactgtggaagcagccctgcacttgtctccctcacccagttcctgagcctgcgttgaccctaacctgaaattggtctgagtcctggctccccctgccacccacaacttagccttatcttatccaatacaattgggccccggacacactggtgactccagccc

SEQ ID NO: 16015 - DNA, 1122 bp, Homo sapiens
gtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggtgagggagtgcaggtggggtgggggggcacgccctggagtctggtccaggtcctggcggtgttgtctggtagagggagagggcctgtctgtgtgtgcagcagctggatccccttcttccattcctagcccagctgggggctgccacacctctagcgcggagggcctgggttgacaggctgcccctcccccctccccttccccttccccactcccggtggaggctgtcactggtgtccccacttctctgagcatcccccacttcctgccccaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtaagctccagccctgcttcctcgatgtaccgtgacccgcttgttccccgattccagcccaaacctgctttgctgcctttctgctgggctctgtggcccagcctccctgaaccttgttcctgccctcctcccacccctgtcctcctggaggaaggctgcttcaggagctgcaggctcagggtagggcaggagagtcccccgtccaaagcccctagacagctgggtgcagggaacctgtaggctaagtggcccgcagcttcactcccctagtgtccacagcctccaccgccaggccccggagcatcgcctgaagagccagctccaacggtggtgcctgtctcacggccacgggtggtctccaagaactgactgagcccgagacgtggcggtggaggctgcataccagagtatctagggacagggtcccgggtcccttctgtgagtgacactccctggtctcaccgtcctgcccatccttgcccttggcagtggctgtcaca

SEQ ID NO: 16016 - DNA, 1203 bp, Homo sapiens
agccccttccctgtgtggatgatggttgccagcctgctgcccgccatcctggtcttcattctcatcttcatggagacacagatcaccacgtgagtggtcctagccaaaggggtgtgagaggccagagccccaggccaggctggggaactcagcatggaacctccagccacactgggcaatcccagggacctcagggaaccttggatgcccagatggccacagtttattctgtagacagcagaaaaaccccgatgtttgctgggacaggaacagcacgtggaggggcaggccaccctggcagtgctagctgggagctgtcatggacgataagggctgggggcccaggttttgctctgtaacggaatttgaatcctgacggaatggacagggaccgccaggttccaaagccagatggagggactggctgggcattctggaaagaccctgtggtctgcggagctgagtccagcctgggcctcagcagcacccctcccgctctcaggctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggtacgttgcctcttgcctttcccttcccagtggattccccagggctactggggccaggggaccccggggccaactctttctcctgcgcctcccgtaggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtgagccccccagctccccaccggaaggggtgtgcctctggccatcctggtctacttgggtcactctccagctgccccctcccatctgcccagttcagccagcccccacctcctctctgtaccaacccagctctggcacctaggaatgttcttccatccccgcctccgaagaagagagag

SEQ ID NO: 16017 - DNA, 1120 bp, Homo sapiens
ataaaactgggccctgaagcagcagagggctttgcccagggtggtggcactagactgggacagattaggatgaggtgccgggcccttcctgctactggtgtcctttctcctcagtcacaaggacatagtagctgaggggttgcgccagctgctgggggaggagaaataccgccaggacctgactgtgcctccaggctactgcacaggtgagcaaggggcaggcggcaggcccggggagacggagccctggctaaggccgccggccctgctcccctccagacttcctgctgtgcgccagcagctctggtgctgtgcttcccgtgaggacccaggaccccttcctgccatacccaccaaggtcctgcccacagggccaggctgcctctagcgccactactcgagaccctgcccagaggtaaaggaggcagggtgggggagccctggccaccttgcccgccatgccctgagccacgtccctccccctgcagggtggtgctggtgttgcgggaacgctggcatttctgccgggacggccgggtgctgctgggctcgagggccctgagggagcggcacctaggcctgatgggctaccagctcctgccggtgagtggccctggcctggcccgtggcgcatcctcactcccagcctgcgggtaacctgccgccctctcctctccccacagctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttccccgttgtgaatctcagttttgggacggggagcagagctgagtcccccgcctcttccattcatgccccgccccccatacaaagacaaaaggccacagataggtgggggccaaagcactttactgcaggggcagtgggggaggagaagactttaaattattcacttaaataaaaaggagggaggggcatgggagggggaaccccatcccaccagcctgtcccctcgtccat

SEQ ID NO: 16018 - DNA, 1163 bp, Homo sapiens
ggctaggtgttaatgaagaatagggagaacagtagaggaccacggacagagacccagcctctcaggcgtttgcccaggaacgcttgctcctgctcccgtcctatgtctgcggcagacatcatgagtcgaacgcactccttccggcctcgctagggtgccaccccagattcctgctaatagagtgccctaggaagccaccataatttgtcacaattggtatgagatgaaagcctatttgccatctttgtatgtactccctacaaaccgtttcgatacctcatagccacatgatactttacatgtctctagtgtttgcacttaaactctagcacaccttcccgctcaggaaacgggagaggagaaaggtggagaattcaccaagtaaccccatgataagaacagcagcacagctctgttaccaggctgccttttacctctccccctcaggctttccatctgatggtcccctggtgtgtgccctggaacaggagcgaaggctccgcctccctccgaagccacctccccctttgcagccccttctccgaggtgggcaagggttggaagctgctctaagctgcccccgttttctgcggtatccacggcagcatctgatcagcagcctggcaggtgctggagggggttaaaatcagatgggggtggggagggctgacaggaggaggaaggtgggctcagttggctgggctgaggtggaattgagccagccggaggtccggctgaggcccagcgtgacaggctgctcttcacagaggcaaggccagaggaactgactccccacgtgatggtgctcctggcccagcacctggcccggcaccggttgcgggagccccagcttctggaagccattgcccacttcctggtggttcaggaaacgcaactcagcagcaaggtgggcttgccacccaccctccagtgcatctctgtcattctcagggaccttgtcaggcccagcgcctcgtgcagctcggctatccttttcctgaagcagacacaccctctctgtcccctgggacctgcatcttttctacaccctttctgtggcttgcccacctcctgtcagcagcatgcattcctggaaatctgcagtttcccaaagcactcttagcagcatcctagctccacccatccctctcgaagtcttcagg

SEQ ID NO: 16019 - DNA, 1214 bp, Homo sapiens
gaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggtcagcgcctcccttcccgtgtgctccagggctcagaatgaggcccaggaatgtggcgcttcccagggcctcttctcaggcctctgtgatgggggagatggcatcagaggccagcaccaccctcctaggcggagtccttaacaagggactggctctccagtgagaagccaccttctctgcgccgccaccttcaggccacgagctctgcctgtaccttctgatcaccaccggagggcagcagagagctacctgccgtgttcagccaggcgctcagcctgtcccgctggttctggagttgggtctggagaggg

SEQ ID NO: 16020 - DNA, 1211 bp, Homo sapiens
agcacctgttgctgtattccaaagtccagcaaaaagaatcagaggcttccttttaaactgtttgacaagtgtttattatcagacactgtcctaagggctgggactattctaggctttagaaggttcttaatgcccaggtgggggctgcagtgcttggtggccaccctgtcatccatgtccccgagtgtctccgctcccctcctcagccaggggctctccctaaatcccagcctggcccagcacttggcctgctttgtgctgttgcctctgaagccgttgttcctgagggcctgagcctcagcgcttagctccaggtccttcgccgcccccaactctacctccctcctggcagactccccctagagctgctttgagcaccgtggagatcgaggtggaatccagactcggagacattctgtggcttagaatcctgcttttcaagattggagccttccctctcctcccacagcagggagagacctaggagttgcaaggctcaacgctggagtgactgctgctaaccagtcttcatctgtctctcccacccggcctgcaggattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgaggcggctgctgaggtgggggcctggggggtggctgccttggagccaaggcaagcaggcattctgggcttggctgcttctcagcctgggcacagggtgctggccagcatcacacttcaaggtcatctcagccaaagacatgtgccctaacgcagccctcgtggagttagttgaggtgacagcaaatgcctagacgagcagttgatctggatgtcagatggggccaagtagtgtcatgtttgggcagtggtgctggtggtcctaggcccatctctgcatctggatccgaggcaggcgatgggtgggggccatgcctctgggtgcatggccggcatctcagccaaggttggcatatggagataggggaggtggaaggggacggagctgtctgaggtcaacctggtgcatattctcaggcctgagtgagaggcgggtctctgctcagagaggactgaatttagacaggatctggaggcaagaaact

SEQ ID NO: 16021 - DNA, 1251 bp, Homo sapiens
gcagggtagtgagtggagttgtggcgatagcatgccctgggtgtgcacgcaggccaggagccctgatggcataaacacccccccaacagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaaggtgggtacagagtgactgggcccacacagagcacctggctggggtgggactgaaaggggcctcatgactgaccaaccgccccttgtcttgtctctcctgctgtgcgacagactcgactggggaaccagaacgcagctctggctgtgcaggccgtccgcaccgtccgcggcaacagcttttgtatcgactgcgatgcacccagtgagtgcaaggctggtggggctgggagctggggatggcccagggaaagcttcgcaagcatcagggagcagggaagagggcagggaagccttccctagttgtcccgcgctctggtggcctgcctgctgtcgctgtatcattctcctctccttgcctagatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcaggtgagcagatggtgccctggagctggccaggaatgggggaagcgttgggggctcccagcatggggaagattggagtggctgtgatggtattagaagggttaaaactgtctgttgctctgcttggcagttggccccttgggggtgcccctcctgctctggtgcctgtcactcaggcgcctcacaacaacgggccctttctgagcgttatcagcaggtcaggggccagcaggaggcgcatgcgcagggcccctatcacggtgtggtgcagagcgcccactccggagctctgagatggggagaatgggtgagagataggggagtgtgtggccccccagtgcaggcccccacccgctttgttccagcactgccaatccaagagagttcagacggccagataagctgcaacacgggcctgcctggaatct

SEQ ID NO: 16022 - DNA, 2582 bp, Homo sapiens
gtttcggatcttggaatatttgcattatacttaccggctgagcatccctaatccaaaaacctgaaattctccagtgagcatttcctttaagcatcatgtgagcacttaaaaggttttggattttggagcattttggattttcagattagggtgcgtccaccctgtaccacatgattagttacagcaggtgctggagaagttggtcaggggcgtgtgaagctgtggtaagtgaaaaaagcttcagataaggggtggggcaagaattggaggaaagttagaaaggaatcccaagaatgggggctggcaagatttgaacgaatgaagggaagaaaggtcctcaaaaaaaaaaaaatggatgaggtcccagtttgactggggtggaagaactagtggtgaagagggataggggagttcactgtaccaagcgtctgctgctctcccctctcaggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatggtagggctccagacctgggcataggggtgggcgtcctcccagaaaggcccccaggagcctcatggccatacactgtccacagcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccaggtgagtccctccctccttccctacccccataactcccccatctctccagtgtttagtgttcactccagtggaactgtttggaacaggagtcagtggtaagtgtcaaatgagacatggacatctgcagtgtggagggggttgttgtgtatgggctagagagagagcttcctggctgaagtggtagagtgactcagttttctattggattcttagcacccagcacagagtttagagatcctaggggtagtcctaggtaaaacggtggagtaggtctgtttctgtcctcccaccaggattccctttccaccctttttgtactctagtcctgctaattccagctgtaaagataaaatgttagacggctattatgatagctgtcgttcttattctcttgtggcctggactcaaagtgagtttccatagaccagcattcccccaataatccccccagagtcactaaacaggtaattccttgccccatcattctctgtgaagggaatttataagacttgatatacttctctagaaagttgcctgcatgtgccttagagtataagcacagtggttccacatgctagcaaggattagctgcctccggttcacccaaggagcttttaaaaacacagatttctggtttgggaaccagagctttagagtctatccctcgctagactctggccaccccacaagataggtctatcttcagaccttcagataggtctaatttgttttagcagtttatttcctctgtatttttttgtcttctccgtagtctccaacttcagtgcacaaggctcataaactcataaagacttctacagccttgcctcgaactgtccttatatgcttctgagccccgtattctactcttcaatctcttctcttcgactcttgtttctgtcctgcttctccttttccctctgaggtatagagcctaaaattgatttcaagactcaagccaggagcctactcagaattgcatgtagcaggcaagtttgtcccgtcctgtgtcacatccattataattctgaggtgcttctgtctcctttaccgtccttcagagccctctttattcggcccttcatgctgctcctggatgagcctaccaaccacctggacctagatgcttgcgtgtggttggaagaagaactaaaaacgtaagagggtggaatgggggatgtgagcgggcaggtcccaaagggggaatctagaaaatggatgcccagaaactgcactgatgttagagcggtgagaaaggaactgaaggaaggacagagttcactttcttggacaagcagtgagcacctttagggctgttgaaggctggccttttattttgattgtttttctttagtttgaaatttatgagcttttttttttaaaaaaaatccttgttggttttgtccatatttcaaattcaagatcttaattaaagatatattttttttcttaattgtataaagctaaaaagaggtcttccatctaagatcatgatgcagtgacaaaggaaaatatagccaatatggtcatggtcctacagctaaagaactgaataagctggaatattgtaccaattttaaaagaaggcttttagtggtacgatgacttagtaccttctttcaaaaagtaaagcattttgttttttattgtgtctgtaccagttcttcccacccacagttttggatacattcgtgggt

SEQ ID NO: 16023 - DNA, 1216 bp, Homo sapiens
tgtcaaccaggctggagtgcaatggcatgatctctcggctcactgcaacctccacctcccggattcaagcgattctcctgcctcagtctcccaagtagctgggattacaggcgcccgccactacgcccagctaatttttgtatttttagtagagacagggtttcaccatgttggccaggctggtcttgaactcctgatctcaggtgatccgcccgcctcggcctcccaaagtgctgggattacagatgtgagccaccgcgcccggcctaaacctttttttaatacatatttgtaagagtgcacaactgaaatacttcacaccttcactaaaacatacctacatatttcttagtaaaattttttaagagtggaattctttttttttgttttccaagttaaatctgacatatttagaatgacaagatgttacgtggatccaagctgcccgaacgattgggtgggagatgggagcttgggccacctgctccttcccacatcgccctcctccgaagcctctggatcatcctcctaaggcactgccagacacaggtagaaacccctggggtagagaaccctgctgttaccatgagctttgaaactttcatcttccatccactgacaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctac

SEQ ID NO: 16024 - DNA, 1579 bp, Homo sapiens
acttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattt

SEQ ID NO: 16025 - DNA, 1134 bp, Homo sapiens
tccctctgcccctcaggtcacccatcctcttcagtcatactgctcagcttcttgtcttaacaagaattgctttccgggcttgtgaattatttttctttgtcatggtttctttatgttgcccaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgc

SEQ ID NO: 16026 - DNA, 1234 bp, Homo sapiens
tccttatttaccttcttatccttggccttggctctttcctcatttctgactctgcaagtcacacttatttaagactcttatacatatgtcattgtatctttcataaaatgtttttttaccatcttaacctgcaagcaaaagtaatatctgtttccctctctgtcttactttgtacttagactgaatagtaatctctcttggtgacttagttttattagattcttcttttatactgccattgctttcccagctatttgagaataggcatgtttctttatttttgccctagtgtcagataatcgactctgtaaccattgcttagaagataaattttttttattaattaaagaataatgttaatgaaccatgttgtaatgagttgatactgcataatttttcaccatgtgccaccttgtgtcatcagtcagttttaattactaacaaaagttgattgcctttaggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggtactttgctactccttttatgaccccacctcctacctccagcgaaaatgtccttggcagtgtctcttccaacatcagagagagacaccacttatggtggtgtgatggacacatgttcctggtgatggcaccagcgtatatcagatgtgcttgggctgaacaccaaagagctacaacaggctgttaaagggaatattatgaggactacgtatttttaaatagagtgaaccgtggaccacatagtttggttttatacatgtattttttccctagctaaattatcacatgctaaatattggaacatagtttcctttctactattaagataaagaaccactgtcacttttgaatataacataaaaataatgtatagatcctgtttttattaaattttgacttgttgagattcccacacatttctctttgcttttcaggattcccgagaaagcaccaagagggtagagaaggacattgtcttctgtagtaataactgctttattctttattcatcaactgcacaagcgaaaaactcagaaaacaaggtgagattaggataatctcagctgataacaatgtgtaacgagtgacttctgtgttctgggcatatgggagtgaataaagatgtgtccctgc

SEQ ID NO: 16027 - DNA, 1099 bp, Homo sapiens
taagaccagaaattcttaagtttttcatagaactagggcatatcttaatgagaacttaaaggatattttgataatattttgcaatttcttgattgcattttaaagttatccttcactagctataaccacgaaacttgaagaattgcataaataaaatcaggtagaaaggaaattagcttcttaatttcagagcttaagtagtcaagctgggtaaagtaagcaagttggtatgtccataaaatcacgagtatctgttccactaagaagcctcctggccttgtaggtattgttttcttggtgtgcaagatacatcttgattacatttctgtagccttgcttctatgtgcaaaaaattcacagaactacgttttagcaaggtcattgcatattcgctcagtagcatataatttaaattttttggtctcctgcagcagaataatttaagtaatcctccaacaccccctgcctctcttcctcctacaccacctcctatggcttgtcagaagatggccaatggttttgcaacaactgaagaacttgctggaaaagccggagtgttagtgagccatgaaggtatgattatagcctccaaatttcacacctcggagaaatgtgcctctgccagttgtgtattgtgaaatggcaatagaattgtaaagttctacccatttatcaatattgactgaatgtatttatggttttgtgtttttgcttttccagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggtacaggttatttttttctcaaataattcttagttatttcttcttttaaaaaaaataaatgtatgtatgtggcataatgtctttaggaatagcatgtaaaaacatttgaagagtacaatttggtgaataatcttcaggatttaaagtttataagacattgttaccattaaacataattagtttgcatttttttaagcctacatcatatagagagttaaataatctaataga

SEQ ID NO: 16028 - DNA, 1244 bp, Homo sapiens
taaatagtaatatacagcttttggaatacatttttaaaattgtatgtatatcttgatacgttaaagcatttgataatgccagaggaaatactttcatgtaagcagtaatgcttctgtgaagtttttatagttttaattagaatgagtaacatttctctaaacacgtttaaccatgcagactgatcttggtcagtcgtccatttttgatttgctttaacattagatatagaaatgtatgaaaatgtatgaaaattcttaaattgggaaatgtcttttgttttagaatataaaataactaagctctcaattagtttttaacacagactggaatgagaaaacatttccttagagttcgttataaaactaaatcaacttatttttattctgaagtcttgaattcattttatcgtaaagtggagtgaggcacataatagagtaaaacctctagagtcagcctagctggcttcttattgcagccctactagtccttgtggggaaggttacggaatatctctgaatcttactttcatcataagtaacatgagggtgctaagagcacacttcatcgaattacagtgaggatcacatctgcccagtacatgaaaggtagggctttagtgttttgatgaagaagaaattgccactgttcttctctggaagagaaaactgttaagcacctaatacagtttttaattaatattaataatttctaaacgctcatcacttgatacttgtgtaccctgttttgacaggttcccttttatgggccaggtggtaactggaacacagaacagtgaaggacagaaccttggaccacaggccattcctcaggtaacactgcctgtaatgagtccctctagaatgcacgcttttctgtttcccagcaaactcatgctttagagtaagtcccctgctagagagtagtactaggtttgtgcagaagtaaatgcggatttcaccatatgccatttgccagtggcaaaaaccgcaattactttttcaccaacctaaatagtagccttatctatcagcacagccaaaagtaaccaaaaagacactttactgctttttaaacaaaagacaaattaaggttaaaaaaattggctgtgatttctgaaaaggatttatatacttacgggtaaaaagtcacttgatggcaaaaccacacgctcaggacttttggttttatttttatttacttatttttaactccagaaggacattttcatgtcctgcattttaga

SEQ ID NO: 16029 - DNA, 1179 bp, Homo sapiens
ttaaatactgaggaagaagtggaaaatgtagcagacattggttttgattgtagcatgtgcagaccctatatgcctgcgtctaatggtaagagaataatttaaactgtgagtctgcactcttgtaccactcacttgcaccttactgtccataaccaatgaattagcttagctctactctattttgtctttgtgaaacttactttgacaagtattttatgaaaaatattatttttggttatacatgacttatcacaacttgttataaaacaatttacatgaaacaataaaaagcatatactttagatgtaaactataattttgcttccaaggaacatgatcttgtagttattgacaatatgtcagaatccaatatgttgattgtttcttagccaggttttcctccatgacttgagtatttccttcatcacttcttgttttgttgttgctttaaaaagcacttttaactttagtgttcaaacatttattttaataaaatgagtatagaaacagaaattataatcatatataagtatttaaatacactttaccttttctgaaaagaattacctggatttttttttttcgtttcagtgccttcctcagactgctgtgaatcttcacttgtagcacaaattgtcacaaaagtaaaagagctaggtaaaatttgaaatgctttacttgatttaattaatttactttgcttaatttttacataattggcttaccacttgtcaaacctgcttcaatcatatgggtgttctatccaaattctgtaatgttggtaatcatttccacaatgatatataaaatgtcatccagctttactggggcagtattcctataaatttcagcaagtaggcaacaaaaataacagctcttagaataaccattaatgccatacttgctttagtttcattgatatattactgtgcttaattatcagttagcagaaaacacggcctagttagcgaacagatttcttttagaattaattcaatctcttaatttttaaaataattaataagcctagtatggtgattcatatgatattcttattaaacagtcattcttttgaatatttgtatttaatagcacctgatacaaaaatgtttggatagtacaggaattgttctaaggaacaacagttttgtacatttaaaattaaatctgcaggatttg

SEQ ID NO: 16030 - DNA, 1134 bp, Homo sapiens
gttaatgcataaatcacatggattggttgtttcttttacagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtactctagggtttgtttgccttgttagtctttcaagttcagagctttctcataccactttggtttttaaaaattagccacacctatttaattgaataatacacatattctatgatagataccagtaatcagaaaaattttcacatacacattaaatcatttcccccattatgttcgtatgtagcttcctgaattacagtaactgagtaactaagaaaataaaattgagacttttcggggggatttggatttcaggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgataggtattgtgctattttttcatctttttaaagcttttctctttgaaatgtagcaaaaaaaaaaacaaatggaaaatagcttttccttaatcacaagttttaggtacagaactttttgccttgtagatttttagtcacctagaaacttacagaagcgatttcctgttttgaattctcaactccggactaaaattttgttttgttttgtttttaaatttagagacagagtcttgctctgtcaccaggctggagtgcagtggcgctatcttggctcactgcaacctccacctccgcctcctgggttcaagcgattctcctgcctcagcctcccgagtatctgggactacaggtgcatgccaccacgcccagctaatttttgtatttttagtagagacagggtttcaccatgttggccaggatggtctccatcttttgaccatcttttgaccgcccgcctcagcctcctaaagttttatgattataggtgtgagcca

SEQ ID NO: 16031 - DNA, 1209 bp, Homo sapiens
gaaggagccgcggccgtgcctggcgggcgggggtgcccgacccgcggagcgcgtgacctagttcgtcccaaagtggatttgacaggttgtcagctccactccccgcccccaccgccttccgggtctccctcctctcggggggaggcccaccgcccgcggtcctcggctcggcctcccattggctctctcgccgcctggcgccccgccctctcggtatcacccttccattggcttgggaccccgcccctgcccctaactcaccctcccactggcttcgtgccgcctggcaccccgcctcagcccagaggacccggcccgccctcccattggcctcgcaccgcctaattccccgccctcgccccggcccgccctcccattggcgtcgtttcgcctagtgccccgccctcgccccggcccgccctcccattggcctcgagccgcctggcgccccgccccttccgcgggccccgctcccagcgcagcccggctctctgcttgtctgcgggttcctgcgggcgttcctcagtgtctgccttcttccttccctcttgagtgttgctcctcttcctctccttttttccatgtctctcctttttctgatctcctcccgtttcggcagcccgagcgctcttgcccggttgcaccccgcagcctgagctgggctcccggtgccggctgcctgagctccaggacctgccctggggccccctacaaccttcccgccgctcccggaacctgacccctctgtgcttcacttctcggttttcttccctgaaataagcagcagcgaatcccttctccaggttttctcatgtgttcagtctgcaaggcttctccctttctccaccctgcgcctcggtttctcccccgcttccccgccctccctaaactcagccaagtggaacagatctcccagcaaaacaaggcagagggcgaggataaaaatgataaatgtcaatatcaacatttttattgctttaggtttttaaaacagaaaattagcaggaacgcccagatcgacccagacctaggatcaagatggagtttcttaaagtaccaagtgagactgcagtgacaaagtcgattatcccagcaatataatcagctttgcctggggaatttacttttactttgtttttatttgtttgtttgctttgagatggagtctcgctctgtcgcccaggctagagtgcagtggcgcgatctcag

SEQ ID NO: 16032 - DNA, 1189 bp, Homo sapiens
ttctaaaaagtgaaataactccccatttagtagtttagtacatcagagaggtaaaatcttgcagcagcggtcctgggagggagggtggaggccgggatgaggagagtgtcttgcctgcttggtagctggttcccttgactttcttctgaaatgagtgtctttctgtctgcctgttgcctctcgtagcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatca

SEQ ID NO: 16033 - DNA, 1140 bp, Homo sapiens
acagtgtgctgtgggccattcatctgggccccaatgagcttagaaaacaactaagtgaacagcagatcctcagccaggtgcctggccccctgttgacctcacctggggtctcattcactgtcccaccttccctggaccaggcttccccctccactgtccacttaccaaagagtcacaccatttcatctagaaaccctcatctccttcttctttttttctcttttccttctcctccttccagctcctaaaatagaaattaatgtagtcctggcccagcagatgcttcagggatctgcattctgttcctaaatgctcagatactcactaaagacaaatagaagtgttgggtccacagtggatgatccctcagtacatcttgaaataataccttgttaaagaaagaaggtcatatccctgctgaggggagccctgggagcgtgtaagtccatctctgggcagggaagctgaccagagatgcagctgttgacatgcagagagaatgagatgtctgaggacaccctctgccagctcgtgtctgagagaggatcccagggacgtgctggtactgagtttcccctctaagcagaagggaacacttcagattccaggaggacatcgaagatgtctaacggatccttttcctcaccaaagagatgtgttatttggtatttttaataacaccatctgccagtgagaggaaagctccgaattgcaatattgatcttgtcactttggggaacagtttgatatttgggattataaataacattttcatttgctctgttatcatgctcaggcagtgtttgatggctgagcccaagaatattattttcttatcaaatataaagatacgtacttttcctgaggtctgaactctgggttgtgaaataatattgacacatattaaagagtaagatgtattctgaaaccttaacaattcagaaggggtgtaaaatttttctccttaaaaatgaaatcgaggacaatatgaggtgataatagcaataactggctagcgtggattaagaggttaagtcagagtcggattagactgtctgatttaagtaacacgatagcctaacaaggaagcacagcagcactattgttcccatgattcagaccagcaaaccaagatagcca

SEQ ID NO: 16034 - DNA, 1695 bp, Homo sapiens
aaccaaattgtgagccttgttaggtcagagacttgttgcatcctttgtgtctccatcccttagtgctgcttggcatatagcatgagctccataaatactggatcttgaatagagctgtcctatgcaagtcagccaagtcagccatgctccatgagtgtacgtgatgcattggcggcactctgccacgctgttactttactaactgtcatggaaaaccaagcttctaaatattatcaatcagtaaaaacttaggtagcaattattcatttcataattttccataggattactagctctacttttgtacttaaaatatcattttaaaaagttaattttcagccaagtcttttaagactcctgctacaggtgtgagaccttcctatgatcactgctgtatggttccttttcacttttgcctcatgtcctctgtctaaaagatcaaacgttgcttctgtataaaattgtaataatagttgctcaacatttcaactgcattccttgactgagttttttctaaaatgcgtaattgtaggaaatgtgataaaatttacagctttgttttgtgtgtgtttctgctttcctcgtaggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatgtaagtcactctttccgaaaaaaatgtcagtattggatcttagaattggatttcacagtctatttcaatgtagtttattggttttgctttttcagaccaaataacttacaagcagtatttgtgtgagaacctgtttacttgtgtgtgtgtgtgtgtgtgtgtgtgtgtgtgtatgtgtatatatgtatatttcagggtcattgaaaaagggtaacagcgtattttaagttgaagatttaaagcagctgagtagaaccaggatgtcagtgatggagtactatccgttgaagggtttccactcttacttagtttaaaattagcaatggcagcaaagagaataatgaagtttaccagctgtacctgatttgcttataatgaacttcatggtagtaaataaataacacaaattcatgcatttgttgaggaaggcttgatttcaggttacagtttatatagcatggagcttattgat

SEQ ID NO: 16035 - DNA, 1221 bp, Homo sapiens
aggtgtcggcggtggtggggcaggatgggtggcagttcccctgtcctaaatgtgggggtcagcagtaataagtgtgtaaacctggaacttaaatgtttatacataattttaaaaaaatatggtagtgcttcattctgtaattggatttttcatcttgggtattagtaactaatctttgactataatatttctatttgaatattcatacttgtaatctggatgttttaaaataggttgtaacagagacttttaatttctaagaacaacactagtaaaataatatgccacttgtaaattgagaatactttttgatttaatcttttctttttcagccttcttgggtgattctgtccgttcagtgtggaactcttctgccgtatccttttttttgagtgggggaggagggaaagggtaactctgggtttaagactgaaagaaatgatagttaatggagtgaaaagtggattcattcgttaggacagattgttttgtctacatcttatattcctactattttccatcctgtttcaaattttatgtacctgatccttgttattactcatgttaaaagggggctcagctgtgacaagtaactctaggccgggaactggaggcaggagctccggttctcttcagcttttgtggtgctagctagatgagggatatttctaaaattctaagtctatgtgaatcaaatcatgaattgtttgaagagtaagttggggaagagaacatgagaataaaatttataacatgcattgttaatccttttaattgcattgggtagaacgattattaattcagtgcacctgtgctgtgggttgagtactgaaaatagaggggtgaagaagaccatttctgccctcagggagcttccttgcttgcattgttcgttcatggagcattcatagatgtgcccttgccctggcactgtgtcaggagtcagaaatgaggcgttctacaggcctcctgtttactcttctaggcctggtggctcccttttcatcctaaaaggataattcttcatgggactgttacttcaagtgtaacttgcttgtggaaatcatttcttttgcaagtacctgataccatacagttgctaaaattttagacctggcaagagattatgtcatgtgctctattttattttgcagctatgccaggcagttctcttgaaagcacttattacccattgaatcaatgcagatggaaggaaactta

SEQ ID NO: 16036 - DNA, 1059 bp, Homo sapiens
gtactgggtggtggcaggagtgtcagagctgtgatgtgacagggtgtggacagatgctaacctttttattgtaagatagaaatcacaccggatgaaaagacaaggtgaactacatagtcatttaagttctgtgtgctttaggcaaatgtggatattaaatataaggttacatattgctcatattaatatgaataatccctgcttgattccttcctgtgtttactgagacatgttcaactacactaaataatagtgatttttaaaaaacttttccaaacagtacaattttgtgggagtggtactcaaagagaacaagaatataaaatcactctgaagttatagctgataattttttctaggaaaaggactggtttgagtaatgtactgtgttactaatgaccacgttgaaattctggaacttgaatctgctgtattctaacattgtcaacttttttaaaacagctgttgttggcctactgtacccctgtatcgacagtcacctcggagaaccccacaaatttaagagagaatgggccagtgtcatgcgctgcatagcagtttttgttggcattaaccacgccagtgctgtatccttaattttctgtgctacgtccagagtatcttcttaggttatatattgaagcgttttgttttgttatatactcaaatgactccatgtcataatacagacatgatggtggtacctacccatttcagattactaaaaagagaaagaagaatggggctatcgatgacttcatagtaaaatatattgttttatggtcaaaataaatatatatttatttatatttttatatatattatatatatttttaaatatatataatatatataataaatatatatttatataaatatatataagcactttatatatagctttcagcaagtttattcttatggttaagtttttgactcagtgatggcagggagatttcaggtgatcttaatgattactgtaacctgtatccaacaaatcctttctttagcttattacacagtttttatggacagtgaattatctgtggtacaataata

SEQ ID NO: 16037 - DNA, 2843 bp, Homo sapiens
aacctatcataccctaagcatcaccatgctttgataaaattgggtgtttcctttatatagatattaatttagttaaactttcaccaatatcttacacttatataacaggctttatataagggcctcagcagcgtaatttcacctgaggcagagaattatcctaattttgcaggtgagagctgtggctcacggggccagagccatgaagacggtgcaggggagctgggagagctggcctcggtctccagttctctgcacatgtcccacctctcaatcttgttgcttcagtcaaagaaagtgtcaatctttcccatgttaggacctacttaattggtaattaaaatatttatacatttagtgctaattttctctttccttttttttttcctttctacacatagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaagtgttgtatttatgtttgctttttaaaaaacagttggggtggtggtctctgtgtaggatgttagaatttgtaatggagaaatattttgcagttcttcaaattttactgaattttgacacaacctcttgggaagtatttgaatcatccttcaatatacacaggacattggttccaggataccccacgtatgcgaaaatctgcatactcaagtctggcacttggccctacggaacctgcgtacactaaaagtcagccctccgtatacgtgggtttcacattcagcaaataaaccatgtttggttggaaaagctccatgtatataagtggacccacaggttcaaaccctgtgttgtttaagggtcaacagtatgtgtttttcttatggtagaaagttttaagtgcagcacgagctgaattgaacctgccaccttacccctcctcaccaca

SEQ ID NO: 16038 - DNA, 1291 bp, Homo sapiens
acagatcaagatttggttccagaacaagcgcgccaagatcaagaaggccacgggcaacaagaacacgctggccgtgcacctcatggcacagggcttgtacaaccactccaccacagccaaggagggcaagtcggacagcgagtagggcggggggcatggaggccaggtctcagtccgcgctaaacaatgcaataatttaaaatcataaagggccagtgtataaagattataccagcattaatagtgaaaatattgtgtattagctaaggttctgaaatattctatgtatatatcatttacaggtggtataaaatccaaaatatctgactataaaatatttttttgagttttttgtgtttatgagattatgctaattttatgggtttttttcttttttgcgaagggggctgcttagggtttcacctttttttaatcccctaagctccattatatgacattggacacttttttattattccaaaagaagaaaaaattaaaacaacttgctgaagtccaaagattttttattgctgcatttcacacaactgtgaaccgaataaatagctcctatttggtctatgacttctgccactttgtttgtgttggcttggtgaggacagcaggaggggcccacacctcaagcctggaccagccacctcaaggccttggggagcttaggggacctggtgggagagaggggacttccagggtccttgggccagttctgggatttggccctgggaagcagcccagcgtaccccaggcctgctctgggaagtcggctccatgctcaccagcagccgcccaggcccgcagcctcacccggctccctctcctcaccctcctgcacctaactccctcctccttctcctttttcctcctcttcctccttcctccttcctcctgctcctcctttcttcttctttttcttctcctcctcctccttccttcctcctcctccttctctttcctcctcctcctcaccaagggcccaaccgtgtgcatacatcgtctgcgtctgtggtctgtgtcgctgtccccagtcccaccgcagtcctgccgcaggcctaaccctcctgccctgggcactgcctccatgcagaagcgcttcgaggttctggggctaaaggcctggggtgtgtggcctaaagcccaagagcggtggggcgaccctccttttggcttggccccaggaatttcctgtgactccaccagccatcatgggtgccagccagggtcccagaaatgaggccatggctcactgtttctgggcgggcagaaggctctgtag

SEQ ID NO: 16039 - DNA, 1163 bp, Homo sapiens
gtcccagctacttgggaggctgaggcaggagaattgcttgaacctgggaggtggaggttgcagcgagcagagatcacgccactgtgctctagccagggcaacaaagtgagactctgtctcggggggaaaaaggatgggactgcaaaatgccttgtcgtgtgagggcagtggctacgtttcacttcagctgctttttagcctcagtcagcacatatcagtggtctccgatgaaaataatttaaaatttactgttaacacttgcattgtgtcataacggaaagcctgttcttatttatcagatctcactagtgggttgtgtgtgttgctggttgtatcgtacttgccgctgctagttgggtgtttcctgcgggtgaagcacatgctgtggcagagtttcattgtcacatcattctttcctgttctctccctagacctccagtttgggctctcggaaagtaactaacacatacacattttttcacatagagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtggtaacttcagattttcttgtagtagccctagaacttcagaacaaatggcagtaagcttttgtgggtatcctagtatacatttctctcttcttagtctgaaatgaaaggttagtagcaggggtaatggctgaagtttctgctttatagtctcatgtgatgttgcatatagtcttagaaattcagcactccagtcatctggtagtaagaaatcatcctgtaccacagatacttccagaggaggaattaatgagcgacctgatgccctaagatgacataagctgttggaccttgctacctaaagcctctagagaggtatttctgagtgcattacatttgagagatgttattacagatagaatttaggcagaagttgtttattttataaaaatatctttacctttttactgtttaccatagattttttccttaaatggcagtttctcagaattattaacatgtcctccatac

SEQ ID NO: 16040 - DNA, 1172 bp, Homo sapiens
acctgttcccaacagtttcagccagcccccacgactccctctccaggaccagtggagagccccacccccgcctcaggatcgagaccctttcttcttaggaggtacagaaagagtgagtggtgtggagtaacaacagaagctgcattgggtgatgtgcccaaacacatttattttgtaaactgaattgaactcccagttggagatgttaggaatgccaggtttttgtaccatagcagttctgcctgtcatttcaggtgctaaaattggacattgttggtatctgaaatcggaacatctcatataaaagggaatttatgtatagaaaatgacaaatgaagcaatctagaaataagaggcaaaatctggaattgtttccaacattcataacctgtcaacacttgtgacttctgtccacagtaggatagtgcttcagactgcttttctgagaagcacatggtctttttaacctgaagttaatgatgttgtgttacctttcagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggtaatgcatcctgagtgaacctccagggaaaaaatgtgtagcttcaaggctttgtgttccataaagtttcagatttttatttgagcctactaatttgtggttatttaaagaatagagtattagtctcaaatgtactgtttgttaaagacaacttttttcaacaatgttacttatctcaatacaagaaaaaaatgggaaaatgtcattttttgggaattgaaaaatgctacttattataattgtttaaagggtatactactaataaaattaggacatgttttgataatacatttgctcatctgtataaaatttcatgagaggtttaccagt

SEQ ID NO: 16041 - DNA, 1213 bp, Homo sapiens
aaatgtgcagccacggctgaatttctggttgcagaatctgcctgggagggtttcagggtagcaaatgtagtctctgccagcggagtcaggtacatgatgctgtggcttgttgtgactgtaaggtggacttagcactgtgcacagcaggtcctgcttaaaccagcctatactacactaggagaaatgggggctctgggactctcaggacaggatccaaattctgaactgtcatttgcagcaagtttctcagccctgacgggtgcctgatctacacagaatgatgatgacacagagtgcccaccgagcacaagcgtgtggcccctggagaggtgcaggcttcgtcagctccctcctcttcctccgcctacacttaaacttgctggatatagttgtctcatttagctattaaaacattctctgatagtggatagaaaactacagaaaatcctgtagctcatggtatattttaatggattctaagttatttgttcacttttatatcttagtgactatcgaagaagctcaggcttgaaactctgaatgtatttcctttgttgtcaccaggccatcatgcacggacgaggcagaggagtggccggtcccatgggccgggggcgcctgatgccaaacaagcagaacctgcgggtggtggagtgcaagccccagccctgcgtggtgtctgtggaggggctgtcctcgtccaccacggatgcccagctgaagagcctgctgatgtcagtgggacccattcaggtagccgcctgggggtggcatctgtgccacgggtagttgtgtcccaagacaaaatcatttcttgatttaaaacacagtgccctttgtgttggctacttcatattaaaataatacttgggaagtaagacaaataacctgttgtgcatacttagtatcagaacatttgcctcaaacgtttattttgaaattttcagattcttagttataaattttaagaaataaataccccagctgaacagattatcctttgagatccttttaattgtcatagaaggttcacacttgcacacatacatacaaaattttttgttctatcaaatgacttgttttatttgtaataacattacattttaaagtatttagccttcttttccttgctttccagaaatagcttcatgtgctaaatagctgtgacttggtttagattttacaaatatgacagtatcttggattgtatctt

SEQ ID NO: 16042 - DNA, 2600 bp, Homo sapiens
ttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttata

SEQ ID NO: 16043 - DNA, 1285 bp, Homo sapiens
ggcagttcctccagagagcagcagcagaggaggtgtaaggatgttctcaggcatctttttcatcgtgactcttgcttcctgtgatcagttacagccgtcctgtctcggtagagcatgcagtcagccatcctccccatgtaagcagcacgagtgcttgatttttaacatcagcatgagttccgtcgaatgtcgaggggcgttcattctgacctcattactcatcacttgctagtgactgtggcgtgtatgtgaagtaggttaggtctggcttgaggctgtcccactagataatagttacatattttaaattaggatttattcattagagcatctcacgtcacagaagtgagaaagtccatagaattcgatctaacttgtactttacttgtagcacactaaatatgtcttaacctgatttcattaagggctattttatttatttttaacaggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctaggtaatcctgaggtttatgggtattttttcctctttctactaaataattttgacatttgagttaatattacatcttcagctatttagtttcccaaatttgtaaaaccttagaggtcaaattattgatcccctactttgtgcaaaattccttcattaagccttagcttccttatctgtaatacagtgatagtatcatcttcctgttagggtttttgtgaagatcaacggaaataattctgtaagatccttagcatagcgcctggcacatcctaagaactcagtaaatattagcccctttattatgacgatggtggtcatggtggtggtgaggatgatacggtgtgaaaagcttatctcttggtaataataccttttagttaaagcttttttgaggcttggattttgcaagtattaggctaacccataagtctcttcattaagccagagaataaattcaagatgaaaacgttagcattcttggcattgatgtaatagaagagaggggatttactgttatgtgttccaagagtcacatgtattgtaatggtgttaaaaacgggtaggtttagctaaagggtacaaacgtaacctatgaatgtatttttatgcttatttccacattagtgctaaacatatttcaagttttatactttaaaaataccaggacaaagtaaa

SEQ ID NO: 16044 - DNA, 1205 bp, Homo sapiens
cttgggatagtgtgggtagcttcagcactcattgacaacgatgccgcaagcatggaatctttatatggtatggatttccttgttttaaccagtttccttactggaaactgtagtttgggatataattacacactcaattttaaaaacatttaaatctttgtgtagttaacaaagatgtttgatgttaatttacagaattaagaaatctttagatatttttatctaaaaatgaagttttatttattttatatgtgaagaacaagtaagcagcttttcagattttttttttttgtttttgttaattggtttctgttcttcaaattccgtggagacattttttctccctccagacaggttttgctaaagggttacttcttggttttctattttagatctttttattgtacaatttagaaattatatggcttaataaactaaaataggcaattacaatgtttacatgaggtacagtcagcctctatcttatcgtaagatagactgactatcttaatgtgcagtattttggatttattaaaatatatttacttttttttaatagatctctgggagttctatctaccctatttatattcctgtatatcattgatgggatgtttgttacttctctgtaagtatttttcagacttgatattaagagaaaagtagagttgtccttattctggaaaattcagggaagttttctgatgagatttcttaactatttggattttttttgagttcgccttaactatttttattcaaaataaattttgataaatggaaactttgaaataataagatgcttttattgttctctaaggaaagcttcttctactgggttgtagagtgagacagacggacagacacacacacacacacacacacacactcacactcacacactttcacacactcatatacagtcatacttacatacactgacacacaaaccatgtgcacactcatacacacatgctatagcctcacccccatacctgtcataatgctagattctacttttaaatggaaatggtagaattatgtatgataagtttgtggttttttaaaagtttgttttgttttacttgaagcatcacagcctatctcagggataagtagataaatgtagtttaaaggacttaagactatggttgtcacctttagatattcttgtttgtttctcagtcctattaatacttgaaatt

SEQ ID NO: 16045 - DNA, 1167 bp, Homo sapiens
ttgttaatgggcttggagtttctcttctggggtgatgagaaagttctgaaattgattgtggtgatagttgcacaactctgaatgtattaaaagccacataattatataccttacatgagtgagttttatgctatgtgaattctgtatcagtaagaagttgacatttggggacatctcagagggtatgtgggaattctttgtgctgttcttgcaacttttctgtatgacattacttccagttttaaagttaaaaaaattacaaggccagtggtaggagagaggatgtccagagcaggtcgcggggggccagggtgggagcaggagcgtagtagaggccggggtggccgagtaggtgtggacggtgcggaagggtgaggcgtgtggcgagcagaagggaaaagagatctctggggagtttgggttcccacttgacgttgggggacacatttccattttgaagtattatgtagccctgagtaagcggctgagactagtttagactgtctctacctaaaggctgtcctgactttgtatcgtggcggtggcggccatgtgcatcaggtgtggtagatttcttgccaacttgaatgggccgtttagactgtttgaaatgatggactttccattttttcatttttcttgaagattcggtttatgctagagacgatgttggccctgaagaacaatgacatgcgcaaaattccaggctatgaccccgagcccgtggagaagctgaggaaactgcagagagctttggtgagtcaaggaactttcaattctgttttgctcagagcttccgtgtcggcatgagcctgtcatgaaaatcaagaaatagtcagacctgcacgtcagggtggtgtctggtgagtgagagtgctcagaggcagagtgaacgcggctcggttttcctcaggggctgtcccagtggtctgggcgtgctcgtgcagaatgtccgtgtgtggggaagcccatgttgggcgagcgtcctctttgcctcaccccgggtgctaaacttgggctgcaccattggatcatccgatgctttcagagaaggccaagtccccatccggaccaaggaaattgggatgacgtaggtcctttgactctctctgacatgcagccaggatggagactggggcagcctccctgttggagtgagtctttcag

SEQ ID NO: 16046 - DNA, 1149 bp, Homo sapiens
actgtatacgtatgcctcagtttatatacttacttatcctactgatccgtgtttatttctgattttttgatagttttctagggcagagatatatatggattagtcttctagaagtaaattttatatatatatatatatatatatatatatatatatatatatatatagttttaattaggggatgggtacttttgggaatggaggtaatttatggttcagttctagatactgaatttctgattcataaggtgtatgacccgggaattccacttacactgctgagttgttctcaacggtggctgtggccggccacacctctgccagcagtgtgtaggaattcccaaggcccacatccttgccaacaggtgttcatttcttagctctggaaatagcttcttaaatcgggtagagtgggggaaggggggagattaatttttactctaattaactatattacaaatcattgaaaaagttggctaaatcagtgtaactttatttttctccatgtcctgaccattaggtagttgaattcagtgaattggacaaacccagagtccgttttttacgaaaagtattaagtatcctattaatggaaacagaagttgaagacctcagtttaattttcacaaggtatgtgccccaccctttccgacgagacatggaagagaaatgaagagattgttttcacttgtgttgatttacaaacacaaggttgtactatacgtgtagcttaatcttttcggttttatttttaagctggtatgcattagatctggggaatagaaacttgtctgctagcaaactaacaatgattgttaataataaaatatgttaagaagttcttaattgagaattttatttttaaaagaaactggttatgtctcactatgcgagatacccaggattgagatctaggagaggccagctcagccctgacatgtgtttatacgattcctttccagagtatctgacaacccaaagctgggggtgttacgtgagggtttgaagcttttcatcagccacttcttgctaaagaacgcacaggcccacagaagcgccgacgaagccaacgtgctgagagagaaagctgaccttgcaacgaagtgtctgcaaggaaaagcttccctgagaatgtagtcagggaaggaa

SEQ ID NO: 16047 - DNA, 1628 bp, Homo sapiens
caaagcaaatgtggtttcgggaaaatgtgactgcaatggtaactttactgattggagcaggcacattttgtgtactttgtattaaaactcatgtaatgccatgcttgttacagtgacatcttgcacacatgctgtttttcaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagtgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctcgtattttactgtcactggaggctctgtgggctgtcatagttaattgaccataattagcaatatacttttaaagtgggaaagctgaatgacacttttaagacaatgaacattatcaaaacaaa

SEQ ID NO: 16048 - DNA, 1192 bp, Homo sapiens
ttaattctattttaggaaaggaagatgtgttgttgacaggttggcttcagccatgtttttacagcctgaaaattacttatattcatggtgtatttcagtaatgtccttaaacaacttagttaccctcacacatgcattttctttaccagaaaggtttttaaatgaatttttttcctacagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaaaaaaagaaaataaatgcgaatgtgttggtgcattcttcctgagtgggatctggagcttttttgtgtctgtgtatgatttgtgcctgggcttctagtgtcactttaatagcgtttcgtgctgttcattcaggtggatgccgcacctcagttacatgtagacattttcttcagtatatttgaagtatatgaagattttcatattgtaagttgtgatttagcaattgatcaaacatttaattatggtaacatttctacaggagagggaagaaaccattgtataat

SEQ ID NO: 16049 - DNA, 1216 bp, Homo sapiens
ctgtcctttctaaggaaatctgagccttttgcttttttttgctaaacaatttctttctgcgaaatggcccggggagctgatgctgcgttgggaaggggggacgccgctttcatctgcagggagccgacgctgtggcaggagtcggggggacgccgctctcattggcacttctctcgtttctcgccctgcaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcagggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgg

SEQ ID NO: 16050 - DNA, 1154 bp, Homo sapiens
ataacaagggcttatgcaccgtcagattttagcttcttggttttcctcaccttttgacaaagttggggagtctccgttgaaatactcagtccgattttccgtctgacattttcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaaggtaggttgacatcatgtttccttaaaattaggtgagtgaggataactgtgtattagaaattacatgcttttctagggacgtgtgttttcattatcagtttctctctctcttctttcagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggtaactctgtgccctgagagttgagtggtttcctatgattgtgggggtgacaaatcaaagtgtgaagctttcatatttacagtgctatacaagtgttctggctggaacagaattgagagtgatcatgtcacctcattcagttggtacaaggcatggagcctggccagggcaaggttgggagtcaagtcccagttgacacgtgttcagaaatctcacatttgtgttgcacctgctagggcgctaggactcaggaggatggccccagtgtctcagaacacaccctctgcaggagatgtgtcacataccctttcatgtggacactcactccctgcagtccttggcagttttttctgggaatgtttggagagcatttcctgggaacccatcatgctcccagctgtcccacggaggccgtcatctcttcctctcctccaggagccagccctctgaacaccctgttacgctgccctcaagtgtgactgtaccagaagcaaagccccagcagagtggagccaggcagatggggaggacggggcctggtcatgaggcagggaggggacgggtggtgctgcgtgcagggcaagggctgtgga

SEQ ID NO: 16051 - DNA, 2124 bp, Homo sapiens
gttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttatt

SEQ ID NO: 16052 - DNA, 1154 bp, Homo sapiens
ccatcttggcctcccaaagtgctgggattacagacgggagccagtgcccccagcccagcctactttaactgcttttttaacaacccacaggtattggttgctctggcatctgaagaacttgccaaaggctggacccagtggtgagtgtccctgctgcagacagagaaccccagtgtgtagctaaaaacgctttccccgcccagtgggtagtgtcccccacagacagtggtggaacccgacacgtatctgataggcttttcctacttggtcctgtatccgtcaccaccttcctgtcactgtctttctcaggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtataca

SEQ ID NO: 16053 - DNA, 1301 bp, Homo sapiens
ttttcattattgtgtaataagtcactacagtagcatcagggataaattaaagataatggagtttttaaaatgaaatttataggtccttcatacctgttttatcagatcttcagttttgagcttgttaaagtgcagggatttgtagagccagaaatcacctgagtgcttcatttaattgacttatatatggaatagtagtcttgttatttaaaaggcatttattgttttagttctgtctctgttgcatggattggatggtttctcacctttcttatttttagcgtaatcaacatgatacaatcagatagaaatagtatctaatcctgtggaaacatggctgctaagggctttttcctttccttttaggtgctaacagacatcaaagctgacaaagaccaagccaacgatggtctttcctctgcattgctgatcttgtacttggattcagcaaggaaccttccggtaggtaacacagtggtaacacctgtgggtgcgtatttcctagcagctgctcttgcttataaccactgctttgtgcagcactctgcatcacctgttctcttcttgttgtgttttcacttcacgtccaagtgcaggagagtggcagtggagagggagaagttagtgtttgctctgggagtgcatacatttctgtttacacatttagctggatttgtgcagtacataggaaaagaagatgaatagtggttaggagaagaggttaactctctagaaaatcactaagcattaaaacttagttgccttaggatggaaattgtctctctttggaatgggaataaaatgaagcagctctgattacaaaatgcagattcctcatggctgtcgcagggccgtgcgtgagctgctgggccttggcgatccgtggggcatcagatggcagaatggtgctgctgcacaagcgagctggcctccgggtgcctgggatgtttctcgcagaacaaaaggaagccatgtctcggaatgacctactgccagatacaagacactctgtgcctagaagcatatatttttgtttgtatcagaattgttcattcgtagagaaaaaatgtaaaatgttgttttataggtaataaccgtaaccacagaaaaggaagatcttactaattccatcttgtgaggcatagtgtgctctcccgtcatcctaccttaaaccctgctagtgaggatagtggtgtggtccttagtcatgtcatcttgtttgatgattttagagtgcccatacacttgctgactaggcactcagtgtttatttcatcgtgtccacagccgcttttgttgga

SEQ ID NO: 16054 - DNA, 1405 bp, Homo sapiens
gaaatgacttaatcattgagtaaaattgaggccccaaacagatacactgtttctagtctttgatgttatagaggcctagggcactgtgagatttatcatgattgggaagcaaggtgtgaaatttatttgtgtgaaataaaattaaactttttaatgtttaaacatcagatttataaggtaagaaaactacattgcatcaaaagactgcttcagaagttgcagtttgttattcgcatcttcttttgaacatggacatttatatttagttaagtgttttatatataagaccaacaacaaccacagccattgattgattgattgagagtattcctcccaacgtcatagcagtgttggatctgataacagcctgcacacctggagcagtaaaatactataatttgatgggccacattttagggtttttacctacaatctgatttggttgctttactatcattttattcagattatacatcttgcaggtctataatgattaagagaatagttcatttcacttacatcatgtaatgcagaattttttgttagttttgtaggaaattgtgagattgatttggagatcaaacgatatttttgtagagctggtgtgaaaagtatccaggtaagttttttgtttttttgttttaatttgacagttttctaaagttctctaagctgtattcaaaaataaaattaggaagtttttttagcttggaatttttttgacgttcagtttttagctgtaggtcatagttgagataaataagaagtcacatgctcaaaagttactaagattcgcatgcaaactccttgcgttaagcggccctgcagaatgttttctattacatattttggtttcctgtttgagtttagattcatggtaccatgcgggtgatcctggaaccgttgattggagatatgcccttagttggagctttgtctatcttcttccttaggaaaccagtaagtcaatatttatttcatttttattttcccatttggtggcaaaaatacatacccgtggaagaatatataaagtggagaaacaaaattttatcaactcaccgttgtccctttctgttgtgtgaatcctgtgggagttttttgtatttctttgtgccttaactgagagcttatctcttgataaacagctctctttcctgattataaaaatgttacaaaaatttggaaacatggacttcttcagaagggtgggtcttagctcacattttattcaccacctcactgaatatgatttatagatatttgctcatttaatcctcatgactctaaagctaaatgttaacattgttttctcttactgttcagaaactgagattttgaaagtcttatttttccaagtcacacaattaataagagcctgtatacagatccagtttagtctgat

SEQ ID NO: 16055 - DNA, 1168 bp, Homo sapiens
ataccactgcctggccaagcagtggagcccgtgcgtcgcgcccctgcgcctccccggcggccccacgggcctgcagcccttccgctgcgccgccctggacggcgccatctactgcgtgagccgcgcgggcacctggcgcttccagcctgcccgggaaggcgaggccggcggcgacgcaggccagggcggcggcttcgaggcgctgggcgcccccttggacgtccggggtgtgctcatcccgttcgctctcagcctgcctgagaagccgccccgaggggagcagggcgccccgtaggccggcggggtcggcgggcgtctccctcggcaggggtttgcggggcccaggtccctttgggcccgcggaggaggacgtggtggggagtcggggccgctggccacgctggtggtttggacacttcgaaggagccccgaggacgctctcagggccgctttcgctttgctttccttttgcttgtctttgcttctgggggtggatgccttgagacccaggaggtgtgcggatgggtcccttgacagacaggacacagagaaggctgtgggatccaaagggtcagcctcagggtacagtgggggttcctgaggcagcctgcagccggccccggggtgtcccgaaccccgcagagcaccgaggctgtgcgcaggagcctgggaccctcaagtaggtcgccgcgaactatcgggggaagcacgcagagagggtcacgccttttatttttggcttgagatttaaaattataactgataagtaaagctctttctgatttagttgaaaatttcgtaccatgtgctcgctttggttggctcaactccaaaaagagtaatttaataagcattaaaggtaaaatctttgattaccagtaaggtttcttgttcaatatgcattggaagtatttccttccccacaccattgctactcaaactcacatgcctagagcagctccgtctcactgttggaccgagggggctttcatattttcagttgaaaggatgttaactgatgtagcgatgatttaccattatttaaattttaagtcttcagtggctaaatgtgaccaaacagcacatcataagtaggaaaaacttaccagggtgcttgtctatctaaaaagcaatctttgatagtccactctgtatgcccagccgcttt

SEQ ID NO: 16056 - DNA, 1651 bp, Homo sapiens
gcgacagctgaggtactgaacactggtaaaaaattgtatgagggtaaaacaaaagaagtctacgaaaagtcctcctgcagtccaaggacaagattacagcaggaaatgtagctagaaagaatcacctggaaggaaaagctgcaatctcaaagaaaatcaccagttgtatttttcagttattataggaagcaggtattaaaactgccttcaccagaaaatgtggggagacagctttcattgcaccccagtgcgaaatgattccaattgaatgggtttgcagaagaatagcaactggttcttttctcaaaagaaatcctggtgtcaaggaaggatataagtttacccacctaaagtggagttgtttttcaaggatgctgccaataatgacccacagtggtctgaggaacagctgattgctgcaaaattttgcttcgctggacttgttacaggccagactgaattggatatcatgagtcatgctacacaggctatatttgaaatgctggagaaatcctggttgccccagaattgtacactggttgatatgaagattgaatttggtgttgatgtaaccacaaagaaattgttcttgctgatgtaattgacaatgattcctggagactctggccatcaggagatcgaagccaacagaaagacaaacagtgttatcgggatctcaaagaagtaactcctgaagggctccaaatggtaaagaaaaactttgagtgggttgcagagaaagtagagttgcttttgaaatcagaaagtcagtgcagggttgtagtgttgatgggctctacttctgatcttggtcactgtgaaaaaatcaagaaggcctgtggaaattttggcattccatgtgaactttgagtaacatctgcgcataaaggaccagatgaaactctgagggttaaagctgagtatgaaagggatggcattcctactgtatttgtggcagtggcaggcagaagtaatggtttgggaccagtgatgtctgggaacactgcatatccagttatcacctgtcctcccctcacaccagactggggagctcaggatgtgtggtcttctctttgactacccagggtcttggctgttcaaccacactttctccagaaggatcagctcaatttactgctcagatatttggggtagacaaccatttagtatggagcaaactgtgagcaagcattttgaacacatgtatttccttgaagcaggctgacaagaaaatcagagaatgtaatttataagaaacaatgccattgaaatttttaggggaaaaactacaaatttctaatttagctgaaggaaaatcaagcaatatgaaaaggtaattataaattagagaacacaaataaaatgtattagtgaatcaatgcttctctagatccatactaataaacatgaaaacctaaaaaaaataaaaaaaaataaagggaaactatcatgcttaacttaacatgacatctgcttttgaaacattttatacattttaaatttatgacacagaaactctccctgctccttcctgactccagggcaggcacatgcccagtgttttcaggtgttggaggttggcagcatatgagaaggacagactgtagatgcagagttctgacatgaactgagatcagacagcacttaaatt

SEQ ID NO: 16057 - DNA, 1107 bp, Homo sapiens
ttaatgttttccagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctgaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaagacaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagt

SEQ ID NO: 16058 - DNA, 1187 bp, Homo sapiens
ctttaactaatgtgagatatagtatagatcttgataagtgtctttctggtgttcctattaaaattcattataattaccgttcctgcaattgtgtagcatcttacagtttccaacaccctgtgctagccatcatcttatttgaaacacataataaccctacaagttcactgatgtaggtaagaaaactggtaccgtttctgaagatacacagtgattgtttcggccagttaattaaggcaagagatcactcaacaattgttctacagttattcctgcttttttttttttaactcactcattaagtgaaagaagccagtccgaaaaggctgtatattttatgattccaactgtatgacattctggaaaagggaaaactgaagatagtaaaaggatcagggtttgccaggggttaaggggaagaagggctgtgcaggtagagcacagaggattcttagggcagtgaagctgctctgtgtgatgctacaatggtggatccatggcttcatacattggtccaaacccacagaatgtacagcaccagatgtcaactgcgggctctgggtgataatgatgggtcaatgtagattcatcagttgtaaccagtgcaccactctggtgcaggatgttgatcgtaggggaggtggctgtgtgtgtgccacggaggggggatatgggaactctctgcactttactctcgatgtggctgtgaacctaaaactgctctaaaaaacatagtcttttaaaaaatcatttactacatatgaaaaggaacaagtaaagcaacaacaacaaaatgttattgtgtactttcagattgcaccagtaaacctagccagccctcactagggtcttctgatggttacatagttaaaagtacactagcacaccgggagaataacttcagaggcttgctggtctaatggtaattgcgtcggcttcacacgtcaacatttttttaaaaattagattttcttgaatctgatcatgtccaagatacctcttattttggtatagaacgcctttattcaaacaacgggagaacatgaacatatccctttgccatagtttggctaaattcctgaggctggctggggccagaaacaaaatccctgaaatggtctcaaaatttttttttttttttttacctctccccttttccttctggttggtggtcttggggcctacga

SEQ ID NO: 16059 - DNA, 1173 bp, Homo sapiens
acacagctcgcaaaactgtctttggatgttcaaatgagaaacaaaactgtgaagagaaggaactggcgtatacaagatgacttctgatatcatgtttgccatgtgttgtggttcttaagaactcataggtgactttctgatgactgaatgtctgtttcagagacgcttcgggcctttttatttttattttattttttattttttgagacggagtcctgccctgtttcccaggctggagtgcaatggcacaatctcggctcactgcaacctccacctcccaggttcaagcgattctgctgcctcagcctcctgagtagctgggattacagatgtgtgccaccatgcctggctaatttttgtagttttagtagagacagggtttcgccatgttggccaggctggtctcaaacgcctgagctcaggtgatctgtcaggcctcttctatagaattccagtctttgtgtcttagtcatgatcataattgaaaggtcacagaacctttgtcattagagcacagtactgccaaataaagaatggaaattcaatgacattgttttattactgagaacaactagagaactctgcaagtttcttggcttagactcgatctttattaatacattatctattaggtaggaaagacatttgtcagctattaaggtgacttttatctagcggagattcctctcttaaagtaatgaaaggagataggtatggggggtgttatacaggataattggtgacatctgagtgtcttacttctgcaagcctgctttatggtgagcaaagcatcaccagcaagtgatcacaatgtccactggccgctttttgcctgccgtcctcgagatgaaattggcagttggggctgattcacagaaacaccgatttgtggctgagcacggtggctcacacctgtcatcccagccctttgggaggctgaggtggacagatcacttgaggtcaggagttcgagaccagcctgaccaacgcagcaaaacccatctctactaaaaatacaaaaatcagctgggtgtggtggcacacacctgtggtcccagctcctcaggagtctgaggcagaagaatcgcttgaacccaagaggcagaggttgcagtgagccaaggttgcagtgaatcaagattgctccactgcactccagcctgggcaacagag

SEQ ID NO: 16060 - DNA, 1268 bp, Homo sapiens
agcatgcgcagtggccggagccgggttgcccgcgccccagcaggtagctgtactgcaactgtcggcccaaaccaaccaatcaagagacgtgttattgccgccgaggtggaactatggcaacgggcgaccaatcagaaggcgcgttgttgccgcggagccccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccaggtgagccgcctcccgctcccgggtctcggcgtccacccgagctcccgggggcgcggacctctccgctcccccacagctggcgagggtcacccggccggcccggcggacccagcacggagagcacgtgccgcctccccgccttcctctccgcatgcttcctgccgttctgccgagatcgctctctaggaagctgtggctgcgtcgtcctgaggctacgagtgggacccgccgcccctttccccgcccctcgcctgggtctgatgctgcttagcaaagtgggtgcagatgcacgttttaaataatagggcacgcgtttagcagtttctggcctttggtccaaagaggtggtcatgttggaacagatcggagacgtctacactccgaagtgcgcttttacagtgacctcttgaaacagaagtacaattcggtcttgtgttctttcccctggacaagtgaaagctgggcgaagaaatgaatacatttgttaaccgtagaagcctaactagatacatttcttgccaactttaactgggcttgaatgtgtgggtgatctgttgtctgattactttctttctgttactgttt

SEQ ID NO: 16061 - DNA, 1770 bp, Homo sapiens
atgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacactattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgcagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaatttgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctg

SEQ ID NO: 16062 - DNA, 1106 bp, Homo sapiens
ccaagaaccctcaaaccacatggcctctggaaagattgtgttcactgaataagtgtgcccaggacttctgtgatcaggggcctttgttcatctttcctggccttgggtggctgcttgtaaaagaagggtgacaatatgtccctcaccaggcaattgtgagaattcaaaacagtgcagaaactggctgagcaggacctactgcagaggtggcactgaacatggagaaagtccacctccctttccaaggttggagcctggccactaaccagctgcttgatctgggtctcccagtcccccaagacacaagagaggatttggggctggggatgtccttcaggcagtctttctagctctgtcatgctgcaatctcctggccttctcaggcattacttcaggttttgtgctgtttataatgagcaccctgaaaccaggcactttatccagtacaacaggaaactggaaataacgtgggaggcttactggaatgctctgttaaagaaattattgcagcagtcaacacttctgatcaaaataaattaaactgacaacaatgtgattaagatgtttatgcacaaaggaagtgttgttgttgttcatggaaattccttgatatggggtttttgatgaatctgattaacctctgtttaggtcttacttgtttttgaggttatttcttaatgccctcccttcccccagctttgtaacccatcaaccactgtattgacagtcgaatttgcagtgtatggtccagttacttgaaagtagaatgcttatttctgccaaacattttgtacctgtgtgtacacacgcacacacacatgcatgaatgcacactcacacacacacacgtagatgactgaactggagctgccctcaagacaaaagcatagaatcaatcggatttaagccttgttattcatgtttaactttagaaacatttacagcttacagaagctggaacctacttaaattcccccgaaatatccagttctgaggctccaacaagagtcctattttggatcccaaattatcttcctctacacaaaagggccagaacctgaaactgcacaccagagggaggatgcagacttcaaagaacataacct

SEQ ID NO: 16063 - DNA, 1215 bp, Homo sapiens
tatgatcctcaatcccaggcctgaaggctgactgggctctctgctgaatggatcttgcttgggtggcctcagagatggcaatggggtagcagatgttcagattcataaagagccttgacaggaattagcagctgagaattgcaatggcaaggaactggaaactgctagtcttctataaaaacaggctcagaactggctcagcattgcttctgctgtattctgccagtcaaagcaagcacaaccagcccagattcaagagcatggaggactagactgcagctcccgatgagtacacatccagggcaggaaggaacgcgtgctggctgtcttgggagatactctgccatagcttagacatcccagccctcaacactcccagctaaatctggagcagagaacttctcaggagactgttctgtgttacaggccaaaatcttttatgtagaaaaactgtcactgaaacaggagggaggtacaaggtcccacttgcctcacctgatataaaaatatacagtctatatgtcatactgcacatagcttccaaaagtgcaccatttcctttgaatgctgaatcttggacatctcctctgttgcaaataggacagctccactaaatccaagccctccctcctccctcagtctaggcacacgcaatatgaatggcaatgacagagagtctatctggctctggagattccctgaatagggcctgtgtgtccctgccgaggagagctgtcatctctggtcatcagtgaatatactctgcaagaaggaacagtttactcttgttttaagagaattggagacattaagaaatatttgccccttgggcctagagcaaacattgaatacagttattggccaaaaagataatttttttgaaaaaaagaactgtgcttctaaagagagattagctattttgttattctttttttaaaaaaaatcagcttgaaatccaaaatgatttattcgtcttaaaatatgggcataaaaattaaagctgcaccacatagagttctttcctttgcatgtggaggttttttgctcttgtaacaattttaaaataattggcagtcagttttataactgcccctttaaacactttctggaataaaaaggtcataggtatacaatatttggcaagtgttattgaagctactctttcttgtgtcatattcaaattaggtcagataccctttataaggataaaatggg

SEQ ID NO: 16064 - DNA, 1213 bp, Homo sapiens
gacctgtgcctggagaacctgctgctggtgcactgcaccctccaggccggccccgggcccgcccccgccccggctcccgcccccgccgccgccgcgcctccctgctcctctgccgccccgcctgctggtggcactctcagccccgcagccggccccgcctccccggaagggccccgggagaagcagctgccccggctcatcatcagcaactttttgaaggccaagcagaagccgggcggcaccccaaacctgcagcagaagaagagccaggcccggctggcccccgagatcgtgtctgcttcccagtaccgcaagttcgatgagttccagacaggcatcctcatctacgagctgctgcaccaacccaacccgttcgaggtgcgcgcccagctgcgggagagagactaccggcaggaggacctgccgccgctgcccgcgctgtccctctactcacccggcctgcagcagctggcacatctgctactggaggccgaccccatcaagcgtatccgcatcggcgaggccaagcgcgtgctgcagtgcctgctgtgggggcctcggcgcgagctggtgcagcagccgggcacctcggaggaggcgctgtgcggcacgctgcacaactggatcgacatgaagcgggccctgatgatgatgaagtttgcggagaaggcggtggatcgcaggcggggcgtggagctggaggactggctttgctgccagtacctggcgtctgcggagcccggggccctcttacagtcgctgaagctcctgcagcttctgtgagccaagccccagcctgcaccgtcgctgccccttccctgcctaaccctttcctgtctcgccttggaagcacccatgtctccctgggaaatggtacagatgactgggatacctggatgtaaaatatataaatatatatatagaaaatacatataccatatataaatatgaaagactaaggatgctgttgcccgtccacactcgtctcctctctgcactaagtcctccctgttttcttctgtaattatacacatttccagttccatgcaacgtcctgaggacagttctgtgaactgaatgcagcctggacactggcctcaataccttgtttaggatttcttcacccttttgtcaaattgttatttaaagaaaaaaaaaaaagaagaaaattccattaaaattttttttggttgagtcatgagcaaagctcttt

SEQ ID NO: 16065 - DNA, 1165 bp, Homo sapiens
taagacagtgtcccttcccttcttttcaatgaaggtccctgcctatataaatcatctggcacgctggtgggaaatcctttgctcttccaacgtgttattagtgctgggcagagatggggcacactcaggggccaaagaggacaaaaagtccatgcaaaacttgagtcttttaatggcttaagataatcaggagtcagttctgaatcttacaaagtgctctgcttaataagtaccttacttagcagagcactttgcaaacatattacttattagcagagctctttgtagaccttccacatctggctgtcagatcttaaggttgtgaatttaggctccagttacattcactggagagcataatcccacacgggttatttataaatacagagcctctgattggacggtctcctgccaagaactagtaatacccttgttttaaaatcttcacaaggtaaaacttaaaaagccaaccaaacaaattgctctccattctacttttaattgggccaaacagcatatgctacagtagtaacatgtttttcggagagtgtaaaaaactctgtttacatttgcctcctccgtgggttgatcgaaaatgtataaaactgactgcttctcgccagcctcagacaagaagagtgagttgctggtactcgctactcttttacttcttttgtaaagtattgactcttggaaggctacagtatacaaagtctcaacatgttttttaaaagaaataaggagcaagcgactgccctgctagaaatcacaaaccgatttttgtagaatattttgtgccccaggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagattaatctggtgaatccttttgtcacagttctcgtgtgtgtgtgcgcgtctccgtgtgtgtgtgtgtgcatgtgtgtaaaactgaatggtcacatttaattgctttttggaccattgaatagttgggaagtaagaattttttaattggcatgagacggttcctcaactgttaaattaaccaactttgacctgtctttagaaaaagg

SEQ ID NO: 16066 - DNA, 1112 bp, Homo sapiens
gcaacctccgcctcctgggctcaggtgatcctcttgcctcagcctcctgagtagctcagattacaggcgcgtgccaccacacccgcctaatttttgtatttttggtagaggcggggtttcaccatgttggtcaggctggtcttgaactcctgacctcaagtgatttgcccaccttgacctcctacagacgtgagccactgcgctcagccatagattttactgtcttaacccattttaattcctctgttgagtctctgtcctcccctccaatttgatttgggattttgctgatgagatgatactaaacattgagagtactgctttttactctgacttttattgtgttgtctttgaaagacaaatagtacaactttttacaaggaaacacgtaagagatggatgtccatgaaaacaatattagtatattctattattgtttcttattaatagttacttagtatttacaaacaatttattattagctgtgttaacttttattctatgcttcatatgctctgacattgacatagtggatttctgctgatttttttcaaatccgcaatctttataaccaactgaagtatataatagagcattacattttatctttatttgtgttctgttggatcaagtatttaacatttgctctgaaaaaaatgtttttgtgatgtgtctttgttgccttgagatagatccatttatcctgcctcctagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatat

SEQ ID NO: 16067 - DNA, 1858 bp, Homo sapiens
cctgagcgacagagtgaaactgtctcaaaaaagagagacttccgggacagtcattatcagataggccccaaacctgtgatttttcttgggcaagattggtgtttacttaggggtgctttaaaaatatatttttacaagtatacttgtaggaagttggttttttattttctatttttgtttgtttttggagtttggttaaacgactcttttattttctgttttgccttatcttactaaagtgaagttttcctaaggcaagcaagaagaggagtggaagcacagttgcctggatttggaggcagagttgtcaggcttttcaagctaagagtcttgtgcttggattttccagattaatttgaaaagacctcccatttgtggctttgtacataaccaacaggcagatactgagtgccttggctcctagagttttgtggttgggttaggttgtttttgttgttgttttgttttggttttgttttcatttctgaagtttaagatgccttgactttttaaatgctcttaaggctattcgatgtaattcttactcctaaaactggctgttcttagcctgaaatctaatgctttgttttttgtacctctcccaggtgggtaacactctaggatgacatgatgttataattttaggggaaatcacatttttaccttatgctgttactgggcagaaccacgttttatgtaaacataccagacatcgggtaacagacagtactttaaatgttataaatttggtgatcagaactattaatagcataaatcgaactcaaatggaagcaaaactgatttcatgcaggtcctgaattttactttgccttaagaagtgccctccccacaatgcaggagaggcacagagtgcactgtcattgacatgttacccgactaaggatcactctgttcataagaaaaaggcctgaagtgactctgtttaataaagtcagtttaattttatctaataatgatcttaagacattcccatgtcaaaatttgaaatatggtaattcagtgataactatctcttctaaagcagccgtaaaccctccccactacccgtctttctcccagctcaccctggctttttttgctgggggtgctggatgcaagcccccagccagcacacctgggatgctcaccctgccgcacagttcagaaggcaagtcctcacctgctcgcaaagacccttcttctccaataaaagactctacttgcctgagtttcctcatcagggctgtcattcagtgatgtatgggggtctgaagaatactgccttctatctgtcttctgtttaccacttgctcctctgctaccctcctgccgcaaacagtcttcttccttttggcccagttctgtcccgtgaaattctcagaaggcctcgggagctgcgctgatgtattctctccttgtttgatagctcatcatcagtagataagcctacacacttcagagggtgacaggtttcttacttggagacttcactgcaccttgacttgtagatttgccttcagacagctcttggttatggttacaagtggcccccgagtcccagaatctttcccaggttgccccagaaagaccagccacctgtcacaggtgcagttgtccggcaatagggaagcaacttcatttttgttttatatttattccctcaagtgccctgaggagcatttgcaaactgggtacaataaataagctggattatacaaagatatttaataaataagctttcagtatctattggaagacatgaagcatttgagtgggtttctttatttaaaaaattattctactggagctggtgagaaataatgaagctgtacagttctccagaaattaaaacaatgtc

SEQ ID NO: 16068 - DNA, 1182 bp, Homo sapiens
cacagaactgctactaaaggtaagagaaattcagaatattgagcatcatttactttttttttttttctttaccttgtcatgactttccatactttcggcctcatgaaagtttgtttagttctttggggttttttgtttgtttgttttgagacagggtcttgccctgtcacccaggctggagtgcagtggcacattcacagctcactgcagcctcaacctcccaagttcaagtgatcctccccctcagcctccccagtagctgggattacaggggtgtgccaccacgcacagctaatttttatgttttttgtagagacgaggttttgccatgttgcccagtcttgtttttttagattttaagagaataaaatacgtttttaaacatattaccattgccttaaaatttttaaaacattgaatttaatttcagctgtttttgaaaggtgatattgaagaaattaaaacacttatttgaacaagttataactgaaatttacaaagaaataaatgtcttttgagttttatttgatccagcaaaatgattactgacctaaaatgttttttttctcaattcagcatggagcttgtgttaatgccatggatctctggcagtttactccactgcacgaggctgcttccaagaaccgtgtagaagtctgctctttgttacttagccatggcgctgatcctacattagtcaactgccatggcaaaagtgctgtggatatggctccaactccggagcttagggagagattgacttgtacgtatttatatcccgaaatcattatcgcataaattggaatatttaatttctgttgagttttatctaccttaaataataaccttccattcttacaagcagactaattcataatcctcatttctaattgtatacttttcttcatgaattccatgggaatgttatatacagacactttttgtatatattgtatttattcgagcctagttttaattcgtatgttgaagctccttttttggttttttgaaggctaatgaggatgagtcaatcagcatccatttcttggatacttgcaatgtggcaggcactagaaatatagcagtgtacaaaccattaaaaagctctgagcttctggggcttacattcttgtgctattgacagtgataggtatctagcattattgaaacctcttatgggct

SEQ ID NO: 16069 - DNA, 1109 bp, Homo sapiens
cagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtat

SEQ ID NO: 16070 - DNA, 1723 bp, Homo sapiens
aatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgttt

SEQ ID NO: 16071 - DNA, 1256 bp, Homo sapiens
acacaagcccctttctcacccattcttagctattctaaacatttcacttcttgctgaaacactgcatcttgtgctgatggccaaatatcagaagacaaaggtgctgccttgatcctgctgcagactccttccttggctcgcctggtcctgtctgccttgttcagctctccctggcaccatctgctccttactcctgtggctttccttgcactggctggcaggccatggctgatatatcctggagacaaaggtcgtgagtgctattaatgacaactcccgagggcagcagacggaccactgtgggagttccccctgctcttggccaacaccttgtgtcaagggctaagaatagaccacatcggaaatgagcaggcaggacctagggacacctgccccaggctggcccatcacatgcagcacagtgcgcaggtcccaggaggagatgctgcccttgtgaatccctaacacaaatcctaggaccccaactactgctaaaaatcattctcaaaccaatgaggacaaagaaataatttccctttagtatagtgccaattggtaacccagtgcacatccctctataagcacatttggccatctgtcacggcggatacagacaacccatcatctgttagatgagctcccctggtctgtttgtccatcttcaacatagctctgggatccttgggctagagtgggcccgggagatttgttttagctacagacttcctaggggctttcctttagacccagaaagatcaggaaatgtcacaggctgattcacggtccccactgtgatcgtggataactcacttcacctctcggtgccttggtttctccatctgtaaagtggagagaaagaaggccaacctctttcttctctcctgctcagggatgcttggaggattcgtcattgttgcctatagcaaagctgtcatatgagaaaaagtggtgacctcatttcttgggaaatggaaccacaggaggagagagtgttttccaggggcagtggcacctggaagccacaggatgaacagggagcacagcgggacagggaggagtctcacatacctgtagttcttagagacttcatagcactgtgaacccaggtcagtggtaccctggtcaggtgacccttggtcacctatcttgagctggccacttgtaattctaacaccaaatctcctgatgttaattcttcctaaggtatcagagaatatatggaaggatgcatttgaacactgatattcattgcgctt

SEQ ID NO: 16072 - DNA, 1233 bp, Homo sapiens
tattctaagagtttcctaatactaaggttaaaattttcatgttgacctgagccttttgcaaatttgctttggctctattgatttgtccattatgtgttaggcaaatataacttaagtggagggggaagtttatgaatataatatagctctgtgttttaaacctcagaaacagatttgagtgtttcagtattatagaaacagtgatgactattcatgctctgctagtctatgcctgcaactccaaatgtttgtggttcagtatttcccacctacatttctgtttggtgacattgctcattttaacaaatatgaccgagtctagtttttctttaaaaggatagtttatgagtaatctttaaaaccatttccataccatctgtatataaccatttcggtagagaacacactacactgaaccctgctttagagctgtgtgttgagctaaaaatataattttttaaaaattgactagcaaaatctatggccacactgagaagcctttgaaaatggcaaatacttttcatcaccaattgcccaattcatctttcttctgcttcctcagccttgtagcaaaggctacacagcagcccacagtccacagtctttttgggaaaattggcctgccaccttctttaagctcagtttatttttgacttactttctttgctgtagttatgaaccttggggcattaaaatcccatggcaaggagcataagagatgttctcgtagctctgcgttgtgtgaaatgtccatcttagttttgttaaaaaaaaaaaaaaaaaaaggaaacagcctcacttttttgtgctccctcagaattgcttgctatgtctgttaatacagctgagctttttgttttcttctctttttgtctcaagattgtatatgaaggaggcttttcttctcagctaacaggcatataaggaaaaccatctagagagttttctttagaagtgactcccattagcctggtgtggtggtgtgtgcctatagtcccagccactaggaaagctgaggcagaaggatcccttgagcctaggaggttgaggctgcagtgagctatgatcgcatcagtccactccagcctgagcaacagagcgagaccctgtgtctaagtaaagaaaaagccagaagtgactcccactgcttctgttgatcggccatagggcttccatgggtggaaacttgtgagggagtttgtattaggtctggtcatggagggatgatgtacc

SEQ ID NO: 16073 - DNA, 1962 bp, Homo sapiens
tcagatctctttgggagttctcaattcttttttttgagatggagtcttgctctgtcacccaggctggagtgcggtggcgtgatctcagctcactgcagtctccatctctcctgggtttgagcgattctcatgcttcagcctcccaagtagctgggattacagatgtgtgccatcacgcctggctaatttttgtatttttagtagagctggggtttcactgtgttggacaggctggtcttgaactcctgatctcaggtgatctgcctgcctcggcctcccaaagtgctaggactacaggcctgagttactgagcttgactggacttcttaatttttaagaatctgttataaaaagactctgagactagaacatttgagaactgctgccttgatccaagaggctcattcattgttttgttataacctacatacgggattccctttcagactatgcagtccagattttccatgatgccacaaagcatggcaaattcgagtgcaacctggaagcctgcacgagactgcccatgatgtacattgacgactgcctcagagccaccctggaggtcatggaggccccagctgagtccctttccatgaggacctacaatgtcagcgccatgagcttcacacccgaggagctggcccaggaggtcctcaagcacgtgccggaattccagatcacatacaacgtggatgccgttcgccaggccataggttcgtacccggtggcaaaggcctttactgtgagtccctggagaatgtaaaccttggaaggttgaagagagcatagatccttcccaagggtccagacaccttttggagaaggagcctagcccaagaaattgttgagcccaagctagcagatgctttgattttggggaatgatatctaaagtgggtgaaatcattccattccaaataaacagcttgttagcctttcatcatttttacagtttaaacataaagcaaggaaaaatagaagcaacagaggtagtatgaaaacagccccaggttttcaaatactgtaactttgccaatttgtggatggaagcacctctttgagtataaaacttcttatgaagttgtgtgagattttgataatgtgtgaaaattcacagtgcctgacgaaagatgggttaatagtcttcggccctaggagggtgactgtgcataatggcggttctgctttactcgaaggaatttcctgttttgtaccttgtacggtagacctttatatacaatggtcaagacctttttgcaaatccacaacctgaataacttaagctagtcttgcgtatcttttcctagcggatggttggccgatgaactttgatgacagcaatgctcggaaggactgggggtggaaacacgactttgatcttccagagttggtgactgccatgttgaacttccatggttctgaaagcagagttgcccaagccaactgaaagaatctggaagaggagctcctgtgtcctggtccactgtcaagggagaactgtcacaactccaaggttatagactccaaggagcctacattatttggaactgactcattggactaaattttggcagctcatattgaactgctagacaaagaatggagttaacatttaagcattttcagaatgttgtaggtatggtggtgggacttttcagtttttgctgtttgcctgaacttgtctaaacacattccacagaataaggcttaagtcatcattagtttccatttccttaattaggatgaagtgactatttctgggaagctgggagtatgtgacatttgtgtttaattaaattcaatttaaatattcctcttaagactcgattattctcttgactaaagaccaaagattacattttaaggactttcaaagaggtactcctcatttataagtattctttactatcccagcgaaagtaaaacatgtttggtgtattcatcccatgtctatcacatt

SEQ ID NO: 16074 - DNA, 1055 bp, Homo sapiens
aggcccactagtcagaccagtttagaccaatgcagttttctaaagagcactttcttgttgcatcttttttttttaagatattcctgggttgagctttcagaagggctactctaaaccctctgatgcaattaccgtatagatacatacaggttaactttttaagttgaagttaggccaaatcaatttctgattgtattttatggtaagggaatgagtgtgttcagaaaatgctttcaatccggtcatttaaaaaaatatttctggtgcaatactgtatagacacgtacaggttaacttttttccagcgacctcggaatgtactgcatgtaaaatcactaggaagtgaaacttccagttccacagattaatcatggatatatttgataacagctatcaaggattaaaaggcgtttatttatgttgcatgcttaataacaaaatgttatgcatttggagttttgaactgttaggtcaaagcgtggatttttttgaaggcataactggatttaaaatctatttgactattaactggagaacttttaggtaattgaattgtttaacagttacattactgtagctttttcctccacttaataaggtttatgtttgtagattttatttttttgttatttttcttttgggctgctcttgagaggcaggaagattttattttttaaaatcagaaagttagtaatgaattctttttttgaaagtttgagatatagtttacataccataaaattcactcatttatagttctgtggttttcaatgtattaaaaagttttgcaaccatcactataatctaattttaggccatttcatcaccccacaaagaaatcatattatataagcccttcccaccctcggcaaccactaatgtacttcttctgtccctgggtttgtctgttctgagcattttatgtaagtggaatgtggttgtcttttagtggcttctttaattaagcagtccattttcaaggttcatccatgttttagcatgtatcactacttcattttttattgctaagtaatattccattgtatgagtaatcc

SEQ ID NO: 16075 - DNA, 7867 bp, Homo sapiens
ttgttctccccctggcattggttttaaatatataatgattatgtttgttgtaggaaaaatagaaaaacaactacaatagaaaattcttcccatatattattttgaaatacatatttccgatccgataatccattgctctagcatggaaaatgttggatttacttgtgtttgctttttccaaataaaatggaacttttgtggctacattatagaattgttttagactgcttaattctgtgtgttgttgagaaagggaggagtggggaaggtaaaaatcttgacatactttcttcgtgggtattttttcttgagcgattccatcttagttgattagcagttagcaattgcccattcaacagaaggttttcttacctttttgtgataatgatagctaacgacatcatttcttcttttttccctctcttcttgttgtctctaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagaggtgggtttttatttaactacttggataatttgtagctacttttatgatttagtaatgtcactgtttaaccaggtttggatattagatgatcctaacaattcactatcctgtggcctaaagagacaggaattgatatcctttataaggaaaaaagtctattcacaggagccgagcagattgctcactgctgtgtagtaccctggtgagaggagataaatggagcaaggctgtaggttggagcccctcagtagaatcatagattttgagctgcaagatgatgcaggaggccaaccaagcttcttgttgctggtgaggaatgtgaggttgaagcttgtctgtgctgatgcagtgcgtgattgagtggatctctggctcccgtccatgtgtcctgacacccagtctggtactttcattatgccacaggcctcaattgaaaaatcacagtagggaatttaggccaaggaaagccatcaagttgcaattatttcctaaattttctttggaaaatttcatttcaaataccaaaaccatcctataaaaagaaaacttaccttcttaggtcaaatctctaatatttgactaggttcaaaaagtttatttctggccaggcacagtagcttactcctgaaatcccagcactttgggagaccaaggtgggaggatcacttgaggccaggaattcaagaccagcccgggcgacatagcaagaccccatttctacaaaaaatttaaaaattgtcatggtggtgcacgcctgtggtcccagctactcaggaggctgaggcaggtggatcacatgagcctgagaggtcgaggctacagtaagctgtgtgatttcatcattgcactctagcctgggtgatagagtgagactttgtctcaaaaaaaaaaaaaaaaaaaaaaaaagtcttagagaccagaagtctttgtaatctctaataatctctaggccctagagcagtggtttgtaaatggaggtgatttgctcccctccccccagaggacattggacaatgtctggagacatttttgattgtcctaaccggcaggaatcgggtgctactggcatctggtgagtagaggcccaggatgatgctgtgatcctcaggtgtgatcctgttgagaatgaaacactgtagactttatgaaaacatacaagaccctcatcatttttcctttgcctgagctccctccccagaggttacctctgttcatggttttgtgcatccgtctagtccccctgttacgcgtttacaggaatatggtttgcaacagtgttttcatctaaatagaattatacaaaatagcgatttctgatttctcttgcatattgcacattcttcttatacttcctccctacctttatctgacacagaaatgctgtatgtccagaacttctatcagaggcacctatggaagtctaagggaagaccacatcgcttttaaaaaccctaaaattttgtagtcactagatgaaaatattcagccagtgacccaaaaaattgctaccaatgagactctccattttgccatgtagccagaacttactttgatctatgtgcctggggtagtgaccaagtaggtgggtaggagtaatctcagggaaacttgaggccccagcctcatggctagggtcataatttgaacccaggtctgtctgacatcagaatccatgatgttaaccccaattctaaggggttcaactaccctttctaaatggaatcctgctatattaagcactatttattcattttatataaactagaaacattttatgtagtaagtagttgagagtgttttggttttgcagtttgatcactagttttagaaaccagtttttaaacactttgtggccaattccattactatattaaaattcagatttatttggtttttccttaactattgggattaaatcctggttgtaattcatagtttgagggcgagggtgggcagtctacagttggctgagccctgtttttgtgaataaatgttatcagaacacagccacacccatttgcttctttgtcttctgtggctgcttttgcaatgtgacggccgagttgaggagctgcaacaggcgatgacttgtaaagctgaaaatattttttggcccttgaataagaggtttgctgacttctgacttagggtatcagttgttctgttatcccagtaaaactcaaggcattaggggagaaatgttaatattaatacttaagttgatttgatttagggaaatctttgaagatttctaagtcttaagcagtagaacctgttaatggttttagtttcagcagtaaggacattttacaagtaaagttttaaatgaaaacattttgtatgaagccacaagtcgtctggcctcttgctggtgtccagatattaacactgatcctatttctccttgctgaccaagtctgtcctttgtagtaagaaaggaagaaacgttgactctgtccgatctctggacttagtgttgtagcgagcatgcacctggaagggacttgccagaggacctcctcatgcttctccagtgcttagtgggggcttggagtgcagccccaggtcttcacgagcagttggccacactgcagggccctcaccccactctggagcagcctctgcttcaaaccagcctggatgcttgtcagctggggagaagatcaacctgctattttgggatagaaataaatgctcagccaaacggccagaaacccccattcccctctctgccaaagtgaattccttggcagggagaatcttgttcgtgtctctgcacacttcctgtgccctcctgtggttaagtcagagaatcatccggctctttgagccccaggtgcctagctgctcaaggatggtccccagccagcagctgccaggaatcacctgggagcccattaagacatccagcccccacccaaacgtatcgaatcagaatctgcctttttttcccaaatgatgtttttgctttaatggaagtttagatgttcatagacaagagttttaaatgatgatcaagctgattccatattcgcagttgtaagtagaactgctgagacgtggaagtaccacatggactcacagaggagctgctgtatgtagcacagcattgcacaagagcttatttcagtctagtaaacatttataggagcctgtgtcatttaatcatcaagcctcgcactgtggctcacacctgtaatcccaaaactttgggaggctgaggcaggcagatcacttgaggtaaggagttcgagaccagcctggccaatatggcaaaaccctgtctctactaaaaatacaacatttagccaggtgtggtggtgcacacttgtcatcccagctattccggagcctgagacatgagcatcgcttgaactcgggaggtggaggttgtagtgagctgagatggcaccactgcactccagcctgggcaacagggtgaaggccctttctcaaacccctcaagtatttggcttcaactttatgccgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtccctttggccttaccggctctgttttaggtaagtccacgtctgagtaccagtgactgcagctcttccagttgtgctgtcatgcttatatgttagaaatgatcatcaaaggactcaaaagttttgccactaattgtattaccggggactgtcacaaccaagatttctcttaatttattcaccttacttatctcctggaagggcatattgaagtgctcttggagttctctaaaagggtttttgttggttgtgtatattcacttgggtgccagcgattgattccaaataagtaaatcttttttcccaaaaggatgtaagatggcttatggttataagtacaacaggctaacaaagtacaagtagatgagaaagtaaaatgaagaaataaagtcataggagccacagaattaacccaggaatgaataagtgtgtagtttggtgctgatgttatcatcctttatttgtacattgcttgtacagttgctctgagaaggtaagtcttaaattttcaaaagtgaaatgtcaccgagcatggtggctgatgcctctaatctcagcactttgggaggctgaggcaggcggatcacttgaggtcaggagtgcgaaaccagcctgacttatgtgatgaaaccctgtctctactaaaaaaaaaaaaaaaaaaaaaaaatacaaaagttagttgggcatggtggcaggtgcctgtaatcccacctacttgggaggctgaggcaggagaatcgcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagtagtgtgtgagaccctgtgtgtcactgccactcatcttggccttcggccactgctgtagcaaccagtttccaagtagggctggaccttgccttctgctccagagacctctcgcttcctgcccttgggcttctgacgagctgcaggaactgcctggcacgtgggtccccacaacccagaggaggtgagggccacctctctgctcctcagggccacctttcataaggctccttgaaggtccctcaagatcaagccaactcaacacatccttgataggccttcctgccttctgtttcacttctccactcgtttccaaataaatggctgcatgcaagcttttgcctcaggttctgcttttaggaggaaggctaagacaagcagtaaagcaacatgggcaggcagaaggatgacttctaatagaattatctcatcactatatattttactttatggatgcttgtattgaaaagtcttggctgggtggagtggctcacgcctgtaatcccagccctttgggaggccgaggtgggtggatcacttgaggtctggagtttgagaccagcctgaccaacactggtaaaaccttgtctctattaaaaatgcaaaaattagccagggatgcacgcttgctgtgtgccagcacagggctaggctggagataaaaaggtgagtaagtaggtgcggtgtagtcagggtgaaaactacagatggtccatttccacgtaagtggaaaggtaaaggtatgtacaatagggtggctcctggctgaacctggagctgcagacaggttttctagaaggcataatcctgaagttgagacttgggggcctaggtaggagccagttgaagggacgtgggaggcgcattccagagagaaggagtggtatgagactggaacagaggtgtgcagcagcatcgcatgggcgaaacaacagtagacagttgttcttttgtttttgtttgttttttgagacagggtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattttgtagaaacagggttttactgtgttgtccaggctggtcttaaacgcctgagcttaagcagtctacgtgcctcagcctcctgaagtgctgggattccaaacatgagccactgtgcctggcccggcaactgttactagactgtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttggtgacagtgtagagcagacaggtagatttgggaatttaagcttagactcacgttggagactgagatagctcatctgagaggcactcagggcctaatctcaggcagtaattttagggatgtaggggaagagatggattctgcacatacttgggaggcttgtggaggagtggggagggaggcacagggaggactccagggtggttcatacggctccctgcttctgttcctgtccccctttgtcaagctgtggtctgtactgcgtgttccatcttgtttctaagctgcttttgcccagtctttccagcatttccctttcgtcatgttagtctgtgcctgtctacgtgaactatggtgacgtttattgggcctggcactgtgaggtgctggggatgtgaagatcattgtggctcagccgctgctctcgagggcctctgggtgcagtatgcacacctgtgcctcctgtttgctcaggaagacaggctttgagatgagctggggctgacatccccaccttatcattgggatggctttgggtaagttatgttcatgttctctgagcctccctttcctcattggtaaaatgggtataaaatacctgccagtggagggttgttgtaagtagccatggaaaatgtaaagcacatagcacttatcattttttcctgtgtctttaacagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataatta

SEQ ID NO: 16076 - DNA, 1163 bp, Homo sapiens
gagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcc

SEQ ID NO: 16077 - DNA, 1566 bp, Homo sapiens
tatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaacactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaatactttttcttaaattgtaggtcagtgttataaaaacaagtcagtagaagaaccaaactgcatatgttaaagaacagatgagttttgcttatggtttggtggcattagatatatgctatggtttccaaaaactttggccatttttattttttgagaaaaaaaaagcaatttattgagggtttaggcctcggaaccatccctaaagcactatttttcaaccttttaaaaatccatgtccctttagggtaaggctaaaattctttctttgatgcctcaccatttgagacttctcttggttacacagactggactgtttctgcccccagttcctcagctaggat

SEQ ID NO: 16078 - DNA, 1146 bp, Homo sapiens
gcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaactgattggattagcttctgttactgcaaagggaagagcatctaggatcccgatcatcttaaagcctccttttcattcactgctgattttcagatgacagagactggaaatttccaacttcatgggactttttttttttttttttttttttttttttttgagatggagtctctgtctgtcgccgaggctggagtgcagtggcgcgatctcggctcactgcaaggtccacctcccgggttaacgccattctcccacctcagcctccccagcagctgggactacaggtgcacgcggccacgcccggctaacttttgtatttttagtagagatggggtttcactgtcttagccagagtggtctcgatctcctgaccttgtgatccacccgcctcggcctcccaaagcactgggattacaggcgtgagccaccgcgcccggccact

SEQ ID NO: 16079 - DNA, 1238 bp, Homo sapiens
ttaaataattcatcagcttttctttcttttctctgataggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctctagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgtta

SEQ ID NO: 16080 - DNA, 1255 bp, Homo sapiens
actgtctggatgataggaatgttctttatctgcacaggccaatacagtaggtactgagcacaaaagatgaaggagcacctgaagtgtggccagtaccactggggaactgaatttgtcattttgtttaatttaaatttaagtagccaccgtattagcacagatctggagcccacagggtttgcctgcagaattggacaagtgtagacagacaagtgagcatgtctccgccaacaccaccatctctgtgttctttaacagggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggtgagagcgctgcctgcgggtccacgtactcaggggagctcggattacatgcagcttcttctagttgtgtggtgtaaacactgcgtccacgtgaatgtaccccacacttagtgttgctcttccgacaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatgtgagtgtcctttgatcttaagattgttggcattggggaaaaatgggaccaactgaagcttgtagcttccttgatagcattctttttttttttgagatggagtctcgctctgtcatccaggctggagtgcagtggcgtgacctcggctcactgcaacctctgcctcccaggttcaagcgattctcccacctcagcctcccaagtggctgggactacaggagggcgccaccacgtctggctaatttttgcatttgtagcagagatagggtttcaccatattggccaggatggtctcgaactcctgacctcaagtgatcctcccacctcggcctcccagagtgctaggattacaggtgtgagccaccacgcctggccttgatagcgttcttttgacaagagagtctgcatggtgacctcttggaaacccatgtcatcaccttcttccttgccgccttgtttgtggaacaggtttctgtgtaattattgaatgatgtgaaaataaatttccca

SEQ ID NO: 16081 - DNA, 1099 bp, Homo sapiens
ctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttcc

SEQ ID NO: 16082 - DNA, 1128 bp, Homo sapiens
aaaattgccctgatgtaaaaattacaattagttgaatacaattatgacattttaatgttatatttacatgtgctaatttagaatggaataacaaacatattgtattttccttatgttctatgttcagcacataataattttctttctttttcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacctaacccactatatccattttgctcatgtgttttatgcaaccagctttccatcaaatcctcaatctttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgt

SEQ ID NO: 16083 - DNA, 1183 bp, Homo sapiens
cctttatgccacatctcgggagaggcgatttcgtttatttgcttctatagaatgtgaagggcagttattcatgactccgtatgattttattttggctgttacaacagatgagcccaaaggtaagtacacttttgaaattatcttaataattgtataatttttttatctctagcttgtgaatggatggagcagtataagttttttagaagaactgagtaatgtggtatttcacatgatattgtgctattcagtgttacagactgatatttcttacaaactcttactcacatctcttctcttttcagaaactttcaattgctccatctttctcagcttaacaccatcttacttttgatactctttataaaagactcatattctgcctcttcattcttatatcaaacctgaacagagtagttcagaggactggctttgaggttagccctgggcaagaattctacctgtatctcttctgcgtttgtcatagctcctgcagtgtaaatatattaatagtttcattgtctctcaccttttcatatgttagaataatggttctcaaaatttttggaagtatgtacattcttgcaaatctcttaatatctaacttaacagaagacagctgtattctcatgtgtgcttttttatttgatctgttataatatgttgttttccatgaaatatatgaagaaaatctacctcacagacatggacagtaaaaaaaggagtattttaattgcctttttagattattataggtactctcctttgatactgtatcacaattggctggtggtagttgcagcttcaaaagtctctatagatggtggtaaaagagtaatgagaaccgaggatttctggctggcttacctggatggatggcactagggaccaggtttgaggagaaaaatcacaatttcaattttggtcatgtctatttgagataccttggatatataaaaggatacagtgtatttttttaaaaaataattcatttcacttcactgaaagatcactcactaaaaatcagtataacaaataatcatttgttcgacccatatctactttaaactgtcacacaaatactttaacttagactagaacaattatagccattttttcctccagagacagcaatatggcaaaaatgaaccttaaaataaatcctcaataatttgacaaattg

SEQ ID NO: 16084 - DNA, 1111 bp, Homo sapiens
agtcagcactttgattttgcattgtcattataaagacattcatgatctaatgatgctgaattccatttgaggaatacatgtgcaggggaaacttttttatggcttttttttctgttttttttctttattatcatatttaccttacaaggttaaaaaaaatcaggcataaaagagaggattttcaaaattgaaactttttaattcttttttattggagctttttttttggaatttagtgctgacacgacagtgtttacaaaatacttttacctattattctaatagcaggcagcactacccagtgaaagtaagtctgagtgaattttacattccagttggagaacaacgtcaaaatgtgccctggaaatgtttacttacaagatacattgcaaatgcttaatctgtttttttctcttatgtgtagatcctgattttaataaatttggcaatactaaatgtattttcatttcctttcccaatatagggcatcacatttgatgaattcaggtcatttttccagtttttaaacaacctagaagactttgcaatagccctgaatatgtataactttgcaagtcgttctatagggcaaggtaagtaatcatctacaaaaattaaaagcaagaagtaatactacattgtttctatagattttggcaaccaattaattaaatatgacatatcacccatcaacttgtgtgaaagtccggtgtatactttcagtgacaagtcagttctggtacttgtcagaaaacagccatgagggaagaaacctcatggccactgggtgacattgagggacttgtgtgtacctatggaggaagcagctggtcgtgccctgttcttacagggtggtattttattttactaatttaatgcctgctgactcagaaactggaattttctcagcagagccacctcttagccatggatttacattaaccaactaacctgtaaaattgagtatcagttttgcataattttcaaataaatacagtggtcatagaatcccaagtgctggtgtcctcagagccagctgtctttggctataggtggactaagaagccaagcccttttcctaggatcctgtggctgtgatcaccttccctct

SEQ ID NO: 16085 - DNA, 2194 bp, Homo sapiens
cttctccaaaaaacttggaataaatccaaggaccagtttttacccaaatatatgggtagcacagtttatcacatagaaactccattaatcatctgattttccgaatctgaaaattgagactattaagatattaggatttcagagatttcaagtcacattataatgataagcattattcataaaacttgttacctttaagaaggtggaagtggcaaaccatacttcttttttttcctctgatgtgaatccagcctcagactgagtgaactgtaataattatgaattcattacagagtccaggtggcctgcagttgaagatcatcaaccatttttgcctcacttaattccagccttttgttttctgctggaaaataagtgtggacattgaagcttgagctctcaaagcagttggctggaatacttttgtcagaatacggtacatttctattacatcagaaatatattttcatctcttcttgttaaattgggaggaaatttatgatagcaattatgaagattgttttatgacattcttttgtcagtttggctttctaaaaatctctttttagattatttctcctgttgaacatagtaaaactattgaatttctcttaagaattcctaataggtcaatagatttaccctccagtgatatctatattatttctttctcgtctcatcaaaatgatgacaggtaaactatatttttccttaaacacctattacagttaaattatgcaaatcattaaataaaaatcatacaacttttggaaagttagttcaacatgaactaaaatggcatgctatttggaaatttagtttgagataaactaaagtgtgttgatgccagaatgttcagcttcagtaaatataataagctcttgtgccttgtatgcactatttaaaaaaagttttttttatttgagtccagtataattcatgtaaatgttaacaattagaataatactctgtatgcttttttgatactgattttgagaatttaaagcagattaccttttaaaactggaccaactaagtaattggtatttaatcaaagagaaaatggtaataaacttttcaaaatctttgttaaaccaaacattcaacacaaaataaactagaaggccagaggataatggaataaaagatcattgcaattacttatccttcctaaaaatatagttttatattaattgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcattttagagcacgttttggtcatttttaaaaatacctaaagtgccagaccggaacctatagctactgctagaagtcttaaaaaaaccaacagcagcacaggatgtattaagaattatatgaagtcaggtttgtttttttttttttttttttttcaaagcacagtactgttagctgtttttgtggacaggattcgattaagtattccctcttgtcaaactggaagctaggggaaaaagagggatttttatcctttactcttctagagtactgttaatgcccctttcccacagtcttttatataattaaatatatgtcaatacacattagaatcagatttgaaaaagttaaaacaatttcattgttgtaattgttccctttctgttttcatatagtgaataacctttaaagggttgttttgttttgttttgaattataggagttataatctttggagatgattgcatatctcattagatatgcaatataaatttatctgagtgaacaaagtgctaaataaatagatctacattttgtacatatttatataaaatttacctttaagtatttactttaaaaaatttaatggcttaactcgaacttgaagacacatacttcaactgtccttattgtccattaaactgataattttgatttttcttgcttttatagattttactatataggaatcaagatttaagaaattttgcattaaaaatagtgtaccaatgcttcatatacgttagttatttgctattatgtagggaagaggattgttatttcaaagatatattaaagaacagttgcatctgaatataatcatgatgcattca

SEQ ID NO: 16086 - DNA, 1947 bp, Homo sapiens
gcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacggtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataaatgttgatgactggtgattttcttttggaaatacttatttgggggatattgttcatttttatttgggcaactcaacagaattcagtaacttccttcattaaccctagatgattattagtccattaattgaaaaatcagtctgagttttctgcatttcaagtgttggcttattcttgttctttatgagtacctcaactagctaattaaggactgacttctgtttctcctttccaggaatgcatttattccgaaggatatacttcacaaagtaaatacatttggtataactgtggctttttaaaaaatctaacacaatgtagtaagtttctaactggcttcttttgtcttcgttaaaaaggaagtgaagcttcttttcgcttgtgatttgttagctgagaaaactaatatttaaattctgttcaactatttgagaaatcaatgctgga

SEQ ID NO: 16087 - DNA, 1182 bp, Homo sapiens
aatttaagaaataagtgatattctcaagcaattaagttaaacagaattaagaacaagaaaaaaatacttaactatattactgctgtcctattttaagaaacctaagctgaataagctccttagtttcatacattgttctttacctgagttaagttgactttatttttaatttcaggtcactgtataactgtgaacacttccccacggttgtgatttttaaagaaagtagatatatcgatatatccattggaccaaaatttacttttacagattctgtcaagaatatattacagactgctctatgttccattgtggttgatgttttatttgattttaaggttaaaactggcagccttaggtgtatatgtaaaaattatttagaaccctatcagttaactaaagctgaaaaattgtaaatagttgtcatggagaaaaactcgatgtctgatatttattgacattttttcttttgtgtttctagtgtgtcacaactcacagatatgaatgaacaagaggaggtattactagaacagtttctgactttgcctcaactaaaacaaattattaccgacaaagatgacttagtaaaaagtattgaggaactagcaagtatgttttccctctcctgagcgcacatttcctgaaaaaaatctcatctttacctagaagtaaactagagatttatcttacaggaaaaaatctccttttggagcccagcttggaagccaaaagacaaactgttttagataaggtgagttagtgataattttgaagaaatttacataatttaaaaatagaataaaacaaccttttcattttctcttttagtatgaattacttacacagatgaagtccactttcgaaaagaagatgcaaaggcagcatgaacttagtgaggtaagactgtttatttttttccctttgccatagattttttttttaatcttatgtgcatgagtcctgatctcactttcattatcatcagaaaccatttatgaggtatctgaccttataagacatgatacctttaaacgtggatgaacagctctcagtgatgaggcatcatacattatttgtgctcatataagagcgtatttgtttctaaaacagaaaattatgacaggccctgacacataacttttctgggtaagttatgaaaccattgtaacacttgtagtgaaa

SEQ ID NO: 16088 - DNA, 1613 bp, Homo sapiens
acaggaaatggtgcatgtcattgagaactactttaatgcagctatgaaaagggaaaaaagtgcccagttcttgatttcttagatactgaagaggacgtagtcatttcatttatcaaatataaggaaaattattcaccattttgaagctcaccctagactatgaaaattatattcactgcagagcaattacttctgtcattacctgaagtgatcagtatctatcttccttgtcatagcatgcatctctcaaaaagcctccactcctttccctcacatctgtgatcatcatgattcttttagttcacttctagatgcatattttgtgttttctaaagcatctgacattatcctcctttccgaccctcttatacatatttctaaaaacaggcacattggtgagatgcaccctttttagttaatagatgcattcctaaggagcttttaattgcttatctttcaggcataatcatcactttaacttttccttggagcatatattttgaattgtgagaataattttgttgcttttctctgagatctatagtctgtttctcctcattatttaaaaatgctaaaccttgtatctcactttttctctaacactgatttaatagctaacgaggtagaagcaacattcattctcctggtcttacatatgaatttaagtatcagctttcttgtaataaccttttattactgttctagagactacactaccgacagtgtgggccagccaccagcctgatctcaaagtatcacattataaagttagtagataaaacatctgtgagtgaaaatccagtttcaagaaccagagaattgggttgtcatgtctgtttaatgaagggaataggttttgtaatctatcattttagaaattatgtaactggctaatatggtttaattaaccttagtaacatctcatgaccactgactgctgaaagttctgaaaagaatttttgttttgttacactgcacatttaagggagagtccctcccctatcttatgagttaaaaaagacttcactaggtgacctaaattaaacttagtggggaaaagtggccatgtttggacataaataaatggtattcacactgtatggttttaatatattagtacattctagaatgtaaaaggattaaactttacaatttagatcaatattttgaatatgtgaaaggattaatttaaactttacaatttacatcaatattttgaatatctgattttttttaatgggagaattattacatttcgctgaaatgaggacgagggcaagaaagcaacattgctgatctctctagtatgaaagatttggagggagtgttgcaatatatataaatgaaaacatttaattgtgttcatcatatttaaaaatatagaatatattagagaactgtgatttaaaagtactgttaatgtaaaaaataaagcaagtgtaattaattctttcagaatataaaatttgggcattctctgctgagcagttcccaaattaagtacaaggaatgtttattcattttctgcaatatactatatgtaatagggaataccttgctaaaataaaacttaggatatagtggtaatggctttcacatttttataacataac

SEQ ID NO: 16089 - DNA, 1170 bp, Homo sapiens
cagaatgacaggattaggccaatactttctatgggtcttccagctgtgacagtttgatgcccctctgtagcagaaatcccttcctacatctgaaaacatctcagccccagagccatttccatcttctgtacataattggcagtcagtctctcaggtcacagtgacaatacctgacattgtctcaggtcacagtgatcataccctgggcatgattatttgagcagcttcaacttttggagattatcatgcagagtttggctgttcctgctacaaactatgttttttatgtgttgaaaaattggactccttggtactgttattggaaaggcagtctgactttagtctgaagactgttcatcatttatcaggacccttaagttatttaaattttttatttagtcatttcataagatgacctggagaacataaatattcttctttgcagaaaattgctcctaccagtgctgatagcatacacatttggcttttgtttttaaatgggtaatctttggtttctcgtcaggaaccatttctcctgcccttatgcctgtggtctgacactactgttttctaaagaacatgcaaactgaccaagttctggagggcagctgtctgtttcataagggaacatggtgcttgcacgtaacttttccagctacgtgcagtgcagtaggctaggatatctttctggatgcctgtacgtggtcttgaccaatgtttgactatctgtttttaccgagtaaattataaaccattgcggaggctgagctgatgatgaagtgttgcaatcagacccaccttctaaggcttttcctccttcaaacagctatccttggcatcaaagagatatgaaggctcatactactggtcacttggtaggcagaggaatgaatgatgcgtttcattcatgattattattttctgaattattttttactactgttatggatataatcagaatagattctgaataacagaaaagtaaaattgtttgcgttctggtttcaaacagctgtctgtgagcaagagctgcaaggtatttcatcagaaactgaaatctaggaccaagttcacatcctgtgtaggtcctctatagagatgatctaattttaacttccatttgtaagtctcaaccaaactatttttgtgggatctgtatttcgtaaggag

SEQ ID NO: 16090 - DNA, 1179 bp, Homo sapiens
aataatttctattttattaatgtcaccattaatcgtatcctatgcatttgagaacggttatttattttgtattttttctttcagcaggaaaatgaagcaatatcagtgaaaaggaaagtagattatttaaatggttttgaatatcataacttagaccctatctaaacatctctacacattcctaatattttgcacagacaggttctttgtattgcttgcccattagtggtttgacttgaattttaataaacaaggcttgatttccagaaagctgtatcacgttttcataagccgaggtggactatcagtgagccaagggctctttgttctggagacacacgtagagtgtctctcatgggtacagttacctgatggtgctgtgttgctgtgacctctccccctaggcctccatctgccggagcagccagcccctgtccggcttcagtgcccggtgcctagaggacgagcagatgctccaggccattaggaaagccaatccaggaagtgacttcgtttatgtcgttgacacccggcctaaagtaagtgtcaccgttgcgatgcatgtctttgcacctgagttgtgaaactggagacaggcaaaggctagccgactgccatctcttgtgcaggttgcttcatctgcaaaggggcggttcctcttggcatagtcagtgtctgggcaccctgctggctacttcctggaggtctagtgcacctgaagcctccaactatacaagtacatttcatatttcccctgcccctagcattgtgctgggcacacaggggcacccaaatgaatgtggcttcattttggagattgtgctcctaagtataccgtattagtacttggtttctttctaaaacagccctttctgctctgacaataaaattcactctggagctccagcagttcaattgttgcgaagtactcagctattatttttcaaattcaacttgtagtaatctatacctatgacttggaaagaactataaaatataaggtaaattaaaaaatatttttttcataaaaagttctaggtgtgtaaaaaggtgtagaaaaagatctgaaaggttaaaccctgaactctaaaaattccatggagaagggagtaggatttgcggacgtagagggctttctacttgttgattgttagaaaagtattagtttacaattatgta

SEQ ID NO: 16091 - DNA, 1206 bp, Homo sapiens
aaaatattaatttaaaaaataaaaagataaaataaatcccttcttttgcagcctgcccgaccaccaacagcttagaaaacaacaatcccatgttgatacagaactcgaacattccatgtggaattaaggagcatggtggcacctcccagcggagccatctctaacttgtgttgactgcagaagtttattttactaacttctcatgaccttatttaattttagctattaagcgcattcaatatttgactaccaaaatgtttccatacctggacttgtgcaaatttatatgctgaatggtttacttcaaaataactgtcctggatatcaggaagcttggtattgaaaaataaaattataaatttaggaagttggttcttacctggaacatctcagtgcttgtcatctgaacgcaagggttgagctagctggaggttggggagcgtttcttgtctttctttgagccacaaagaaatgttagtccttgtcgtattcattagttatttgtgcttagcttatgcacattaacatttggttctagattcttcacagtcagatttccaccattgagaaacaggcaacaaccgctaccggatgccctctgctgattcgctgcaagaactttcagataatacagctcatcatacctcaggaaagagattgccacgacgtgtacatctccctgatacgccttgcaaggccaggtagggcagaggaactcggcatttaatatggaacctctcttaaaaatttgcaaatcagattcaagaatttgtatggtgcttaggaatgataggggttcagggattatgtgtcagtctcgttctcaggagaggataagcccgaatgatcatctgatacagagtttcttgtttttttagagtctcccccgagttatttattatgtgagtctctttcatgaatcttagtattaacttaatcttggtggggttataggatgctttccttttggggtgaaattgcctttaagttatgcacttcttatattgtggtaatcgagccaccttgaatggggccagtgacagaactaatcagttgttttgtgtggaaaatgttatcagacagttctagcgcagttttctccctcttgatgcttttaaggtttggtctccattgcttttttgtttcttggggttttggttttttttttttttttttttttttttgaggcactttttctccgtcgcc

SEQ ID NO: 16092 - DNA, 1196 bp, Homo sapiens
tcattgtgctgcagggaatattaggaataaaataacttgggttcccatgagaatatgattgtggtaatggttagagtgtacagtaaagatagcgtgtaatgaagtagtgtaggataagtagaaaccaagtagtgatcagagaggtcacagcaattcagaggacagtgaatgatcccagtggactggggtagttgaggaaaggtgttattaaggaggtggatcttgggtgtcaggctggaggtgagtatgttgcacttggtgagtggcagtgtccttttcttactgttcttggtgacctcagagtgcactgtggcaggcaatcatgcagctttgcttattgggcctcagaagaggcctccacatcattgggtctgcaaggcattctgctttatactcatttcccagagtgggaatgatggacactttagggccggactgtaagaggagaaagagaaaaatatggtgccaattatgcagtctgtccttggggtcttcgaagccgaggagtgaggcatgggaatgtgtaaatgagctggaacctggccttggcctgggtggacagagtgtacccctttgtcctctggcactggtacttgccaggggttggtgggagggagagcatgagacttgggtctctctgtgcctgggctttctcctccctttggttagtaagttctatttggcacaacttgcccttggaaaaatatttccccatagttcccaaagagctatataagtagatggtttcgtcctttgctgttagtgcctttgtcaaaaataggtcaaattcagaatcattttagaattttagaaatatcgttaaaggaaaatcataatcaaatgagcctctgacttcctgtattgcttcaaagcaaggtcttgttctccctatactagtatatgtttttaaaatgactttattgttttgaacccaactatctttagtaggtcattccatacatttactctttgggatacaaagcatcatgtattcactgagttacaaagaaccagcatctgtcctgaatttatttttcttttaacctcttttttcttcttttcctcttctttatgcttgttgaaaatggtatttttggttggggttattttaaggtggtgttgaaataaatcctgggactttgctcttgttcaacagtgcatgttcttttaagcctacatatccagggtcatcctac

SEQ ID NO: 16093 - DNA, 1100 bp, Homo sapiens
aaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaggagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacccagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaa

SEQ ID NO: 16094 - DNA, 1193 bp, Homo sapiens
acctaggttgatttgatttcagatctctttttgatacgtactgactttataggagatcggtaaaggtatctgtaatttatttcactatttataatagaaaatcacaatgtaaaaaaatcctcttggaaatattcagattgattttagggttggcatttgaggatttgtatttgttagtgatcttgataagaaaataatctcttttcagaaggatgggctataaaattaaggtagatgtaatgaggggaaaatgggttaatagaagtaaatatttgtctctaggagtataagtctgtcaaaaatgtcttgtcttttttaattttaaaactgaccaaaactttttaattataccaatctattttcctggtttgatacaggccatgttaatttttgcttttacttttttaaaggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcaggtttgtgaattatttttaaaaatgaagctattactgtgagaaatacttgaaatggattaaataatttgtcttaggaataaaaaattgagctgtttatgtaatttttaaaaaaagtttctgtgcctatggaaagaattttaatcactggggatggtcctgtcttctttagaaggaaatgaagtcccatttctaaacttgctaaagacatgcatttctggactttatactatgttatatgactaactcaagtgattttactatacaactaaattttgcattttggtaactgaataaaatggtattaagtaatggaaagttccagtttagtatatatatcattggctaagtgtgggatgtgctgggttacctcaagtttagaatgaaactattttctgtttataatcaccaaaataaagtttagatctaaaaacaagtagaaatgataataaattcttgagagatattttactcttagatctatatgtcatagagacacacacatttccaaaaatgtagaaaggtagattcaagtctgat

SEQ ID NO: 16095 - DNA, 1175 bp, Homo sapiens
gcctcccgaagtgctaggattacaagactttcaggtcattaacccagtataatgtgctccttttctgtaggggcctagattcttcagtgtgtgtgtgtgtgtgtgtgtgtgtgtgtgtgtgtgtgtccatgtgtccgtgtccctcttggccttttatgttttgtatatctttttcttttccttttgttcattcctcttcctgctgagccattgattatgtagctttttactgtgaaattacctcttaagtggcaggctatatatatatctctgtgtcatcattctgttcttactcttttttcttgatgtctactaaaactatatttagggttgtatatttaataatttgttatcaatgtgtatactttgccattgataattgaaaccgcaacatggattttaatagtcagatacaagtattgttggtcttattttccaggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctggtatgtcacagtctgagaatattctttttgtaaggaagactcatacataattgtattgcagggtggatgctgattattacataatcagatcttgattgttgtctagtttagaaaccttcatatgaggcttatactttcctgtgcttttctctggttatgcagaaaaggttgcagggacaactggccatcatactataccatgcagatagccagatctctctccttttcatcagagagtacccttaagaggtaaaagagacaggctgtagttctgtttttgtacctcagactgataaggctcatgatgcgtttatttcctttttttctattttattcagctaggattgtcattctttgcttgcctcccaagaaagggttaaaaccttaagtgaggcagtgagtaaatttataaagtgtctttaaccttcaaggttagtagtagctagtagctgttattttaattaggtatccttttgtatatgctagctccttggaactatatttatagtgtatacattcttcgtaagactcagaaattttcttcctcctttcctcata

SEQ ID NO: 16096 - DNA, 1141 bp, Homo sapiens
tattaggtattataagtagtctagagctgatctgaagtatataggaggatgtgtgtagattatgtgcagatactacaccattttatataagggatttgggtatctgttgtttttggtgtccccaggggtccttgaaccaatccctcatggatactgagggatgacttcatatgttaatagtggcatatcaggaaaccgtatttaatttgggaatagtaagggtatatacttacctaccagcacagcctagcaaatatttctttctctttataaagaatatttatgcatttaaaaaatgagaatgcatttaattgcgttagtcttaattcttcttttttgttgtttttttttaataagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatgtgagtaaatctggttcagcagtattgggtataagacacacaagtatatatactgtcacataataaatttagtatttggtgaatgaacacatagctcctcaaaaatatttgtagggacttaagacttgcatatgaaaagtttctaagttgcaagccaatatatatgaaagccaaataggtgataaatcagttttataattcagaaaagggaaagaataaagttggaccttgaaaaattagtaggattttaataagggaaaggtagaagagaaggcaactgtttgatacgtggacatattaatactttgtttcttaacattcaaaattttcccttaaagaaaagttaatccagttagtactttgatttaaaaacccaaaactgtgaaacatagtgtgtattaaaaaaaacaaaaaacaaaactatgaaaaacttttatatatggtttagtctagagagcccagaacttccaactgctggatttatattcatttttaaaaaatatataaataatcatctcaagcaggtataactgcgggagttatcttttttgctccacacgtgtttaa

SEQ ID NO: 16097 - DNA, 1099 bp, Homo sapiens
acatccccctgatctgtgggtatgaaaaactgatgaagacctaatcagctacagctaccctgtaaagattacagattgagtactgcacatgattcatagtggccctgtttaacttaacctagaaccaagtttatcaagttagttaccaagtttactcgttagttaaaactaactagagtacttctctagttagttttccaaggtagaatatcattattcttgtcaatttccatcttttttctttcctttctgttttaacccagtggttatattgtaaaggtgatagaacctgtggaagaaagaggtaaacaagtctttgtacattttgatgtgtttaattgtggagtaagttaataaacaattttctgaaatttaaatctgcagaaattaagttgttaatttttactttttagttttcaatatccaagccaactgtatgtgtttgtttatggtaactggtgattaaaaaaaattttttgttgttgtgccttcttcagcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagtaaaacatttataatcattgtttacatgaagttaaataatagggataaattctgtttttttttttatgttgaaaattctgcaaaacgagatttatttaatattgttgtaaacattcttaagggataggtagaagaggcgtgtgtgtgttgtgtgggcataatttgagttgtctaagagatgtgatgtaacatagtttctgtgaactgatgttactttcttgtttttcaaataaaggatcaaaaataagattacagttaaaatatttctatattcagatggtttagagaccaggctgtagaatcagacagccctgaaattgtatcacacaaggctgtgttaccctgtacaaataacttagccttactaagcctgtatttcctcatctgcaaaatagggatgataatatacctgttgat

SEQ ID NO: 16098 - DNA, 1201 bp, Homo sapiens
ttttctggggatgtttttccagcatattcattctgtcttgatacttataatgtgggaacaaaaatacttcgttgtagtatttactatttgccttttatttaagctttctactattttggtcagtgtaatcatctctgccctgtgaagaaagatgaatagggaagtatggagtacaatagttcagtaaatttgccctttgttagactgaattcgagtaaatcatgagatgtatctaacttagcattttgctgtctttttctttttaggcgtaattttcattttttcagatgtttttctacttaaatagcacatatgcagaagttaatgaaaagcaggagtcgattattcaatttgaatttaaatggaatagccaacaatgtgcttggtttggtgttattttattagcagttctaaacttggatttctttctctctttttttgtgccttaaatgacttcaggctgttttctttcttctagaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttaggtatgactgactgtatttacatataattttgctgtgttattcttacaaagtgggttttcgttcatgtgtgctctttcctttaaaagttactggttttaattatacatgttttcagcagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggtaaatattgcttggtcttttaaaaacctatttgtcaaatagtacagtcttaagtaaaatttgtgtatgataattactttggtttaattatactaatacacatttatgtatcatatgtgaggtttaaatttttagcactttacatgctgtatgtcagaggtcagcaacctttttaaattaagagtgagttggttagatagttgcggctttg

SEQ ID NO: 16099 - DNA, 1099 bp, Homo sapiens
taagtaatttataaagcatttttattctgtttttcagaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatcatctgtttgttaggatttgaaattctggaaaatatttatctacatcgcctcagactaaaagtaaaaaaaataagctttatataattagggagatttctgcacagagaagtaacattgtggttaattttaaatgaaaaacttaactttttcaagtggggataaataatacaactaaatttctgtaatagtaagattctgtatgccttcagataaacttgcctattgagatggtaatttaaagccaaagcatagcagtttcttttgtgtgtagtgaggttgaagcagatttgcaggtgaagtattgaaagtttatgtgactttaagtcagcttttgaaaagtgattgatttgctttttatcccaaactgtccatataccca

SEQ ID NO: 16100 - DNA, 1292 bp, Homo sapiens
cagaacatctctgaattgaaaacgtccttaaagtaaaaataacttttctttcagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgattgggtgtgtacatctgtgttggtttggaggaggggggtt

SEQ ID NO: 16101 - DNA, 1135 bp, Homo sapiens
cgtctctataaaaaaacaaaaacaaaacttagccaagagtgatggcatgtgtctgtagtgccagctattcaggaagctgaggtaggaggactgcttgaggccggaaggttgaggctgcagtgacccatgttagggccactgtactgccagcctgggtgacagggagaatgtctctaaaaataagataaaaataaaatgggaccttgttttggggaaagcaaagtggcttaaaagataaatgaggaaatacatgaaaagcactttaaacagttcttggcacctggtatgtgctcagtaagttgttagcatctacaaaatattgcttgtgtattactgataagtgttgtatgtttcttctctacttgaaattctagagcagtgtgttagaaatcaaagtcaaagttactatacatttttggtaggttgtctctcttctctcttactggatttgttagtttgttttctgcttctttgctgcatatatttggtaaatttgttcttgaattcttactcagaatttacaaggatttgcttggcctggaagacggatacttggctttggttaagaatcttcctcactgatatgatcatctatcaggtagagtattatacatattttaggtacctgtgtctgtacagcatggctatggtggcaaaccagctttcctatgcagaatgtgtcatgttccctcttgggctagtccactgcctcctgacacctgttctgttttcagtggctgagggggtatggtccattttcctttcaaagtaactatcggccgggtgtcgtggcttacgcctgtaatcccagcactttgggaggccgaggtgggaggattgcttgagcccaggagttcgagactagccctggcagcatagtgagaccctgtctctacaaaataaaaaacttagccaagtgtggtggcatgtgcctatagttccagctgctcaggaggctgaggcgggaggatcacttgagcccaggaagtcaagactgcactgaaccatgatagcgccactgcaccccagcctgggtgacagtgagaccttgtctcaaaaacaaaacgaaacaaaaactccaaaatgacaagcctgtaccttctgtgttacttttggtatatccaatcacacctct

SEQ ID NO: 16102 - DNA, 1179 bp, Homo sapiens
tggagtctgcctggctgtactgttctccagcatcttagaccttgaatggagatagtcgataattcacgaatgaggtggtgtcggaatgggcaggttgctgcttccatccttcataaaggagaagtggtgcttgtagtaaaatatttctaaagaaatgttatatccaaatgtgctggatcacagggcctggttattttctttagtctcgagacctaagaccagaaagaaaaatcttcatccttataaagtaccgccagaaagaactcccacctggctttaattaagttgatttgattctattgccaattctccgtttcttcctcagatgatcaaaccaagctaccgtctttgtatagttgcttgctcgttgcttcgtgaaccctggaacggtattttttaaatttctttttttaacagcgatgcttttcccctccttgctattctatctttcttagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagagtgagtactgcacacatacatgcctgccgcaggtgcacggggccacctggcctttctcctttccctagcgtggcttttcattcagtgcacgtttatttcaatttgatctttctgcctagatttattacttaatctgctagtgaacatcacaatgattttgttttacgtaattttctctttactacagcttccctgaaataaggcatcagtactttttacatttcttgttcattgttccatttgttggaggatttttctttttattattatttttctttttattattattacactcttgtctcttctgttgtacttggaaacacaaggccattattaagtgggaaatggagatttatatttagcttactcaaacttcagattctctctttaaatggtaataacacgcccgggtgtggtggctcacacctataatcccaggactttgggaggctgaggccagcacatcacctgaggtcaggagtttaagaccatcctggccaacatggtgaaaccccatctctattaaaatacaaaaatgagctgggtgtggtggtgggcacctgtaatccca

SEQ ID NO: 16103 - DNA, 1168 bp, Homo sapiens
taaaaaaagcaatttgcagaaggatacatacaaaatgacaccatttatatagtagactgaaagcatgcagaacaatccattgttgtttacgtgtgtaacagtcataggaatgacaaccactgccttcagaattatggcgacctctgcgatggaagagaatgggatcagagaaggatacacaataggctttaactgattttgtgattattgatattagaaatgtttaaaattaagatattaacatttcatgaagctgagtggtgagcacaccagtgttatattctctctatataactttgtgtatatttgaaatgttttctcataaaaagtatttaagcaagtttaggaaagaatattgataaatgaaatctagagaccatcaaaagccaatttcaccatcacaaagtataattgtgtttcaaatataattgaaattgtgtgactgttgcatattctcttttttgttgttgttaatgaaagcatcttaaacagttgcctttcaaagctgttatctttgataataacatacattaacctaacattgtggacttctgttaggttcggatctgaagctcctgccttgtaccagcaaggctatcatgccatactgcctccatttaatgttagcctgttttaaggtaagcttaaagttgattagcttgaaaaaaaatgtaatttcaaatattattctcatgactcgagaacttgagaaccttgctaaggattgttattttagtacttttgagggcaggcccaaacagttagaaaagcacatgggctactaattaacaaatctatattaaataatgactgcgctaggcaaagagaagtaggaagttctccccgtcctcaaaaagtgtaatagtgggacagatatgcaaataaccttgactgttgtagtgtttggtaaatattttatcaatataaatatattagctacaaagaaagggaatacaaattgcggttaggttcatggagggatgatgagtttgtcattgtaaagatgtgctagattaagcatgttaggtgttgagatcaacaccagtaacagcccaacagttgggaaagttccgggacttgaaagaacgccaaggcccttggctacaggtagagcagagccttagagcagggaggcttcattgtttctggaaggtttgttggccagaga

SEQ ID NO: 16104 - DNA, 1053 bp, Homo sapiens
cagcatttggacctaacaatgaggtaaccctgtatttaaagtccagccctgcttcttggtagttatctggcactgggcaaattacttaggttctgaagctcataagatgtgacagctgatacttgtctcatggagttgttttgcatattaaatgagatcatacttataaattacctaatacacaatcaactctctgtaaatgattttttcctcctacctcaaaaatctggctttcatttgtttcctctctctctccttcctacctgcctgccccaccccagtgttgagaaaccatacaactgagaaatttgggacatttataaataactgttaataccttacttaagaatttgtaaaataacaactgctttactctcctcaattcatttaaaactttaaaaggggaattgtactgttatttccagaatcatttctttttgtgttttctttttggtcttttggtttgagtggcctaagacttaatgttccctttcagcattgagcgaattatcactcctcgcctggctctaaccacagctgaatttctggcgtaccaatgtgagaaacatgtattggttattctaacagacatgagttcttatgctgaagcacttcgagaggtaagttgttcatgtttttccctcagttaaacaaaattggttaattttcagggttaacttgtcactttgcaagttttcattctttatggttttttaattccactgttcatatattaatagaatgccttaataaatcagaaaggaaactacttcgtttttgtcaacttggtagaagtgattagaggttaagatttaaatggttagcctgtttatcatactgtcactatctccatggattaagaaatgattgtaaaagggagtaaataattcaagctgtttattcagttactctctcgggaagttctgtttctgtccagactattaatttttaaacctttttgtaattccatttttaatgatgttaatattttataaagaccctactctcacagtactctcttcagcacttttttcttcagaaaacccagtgttt

SEQ ID NO: 16105 - DNA, 1833 bp, Homo sapiens
aaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatggaccttaactaaagtgactctctatcttctaacgaggaaagcaacaagcaaatatgtaatcacacatctcttcaattcacagctctgagcatcataaccaggattgggaaccagcccttgtgttgcagggacatggcttccacactgcccttgtcattctttttggtactgtcccttacagcatgctgtagtttgatccagggctgagcattcctacaggtgctccccagcgttcctcatttcaggcctagtcaggacctctagagcccatctgctgtgagcaaaagagggtgctaaatagtgaaatacagcttgaagcaagccaaaacctgtttcacataaaatctcacatggatgtcctgtatatatagaaacctggtgaaagcacagggcatgctgtcatggagcctcccattt

SEQ ID NO: 16106 - DNA, 1196 bp, Homo sapiens
gtatctctactgcacagacccatgctccatctgaacaccaatctcttaggcattgctatttacatcttcctacatatcagttatgcctctccatgtcaattgtgagctgcttgaggggagagacttccatattcttccctgtccccatacaacagttaacacaggcacatgccctgtgctctctaagtaattgctaaataaatacattttaaaggaatgtttgtgatccttgataacaccgagcagttttcattttgcaggctgacacctgttggaaccataacatcaattttgcgggctgtgacatcaaaatgcccctagtacgcatgagtattatttgctgaaactttcgtttttgtcttaaatgcctgtcacaggctgggttgtggtttaaaaataagtttcttacttttgatcatggtttgaaaaaagaaaaaaaacagtgacaggatgcgtatgacaaggctcctagcttggatgctgagccccttgtgggcagaatcaaagacattgggcaccaagacctcccagctggagaggaagcaactggtttcagaaaagctctcctggggttggggcggattagaagacaggcagtcaagagaagaaatgctcaggggcctgagcacagtcgctcaaactgcttattgtctgggcaacaaataggcactgcaggcgcacctaaaaacctcaagtgtctttccttcagaaagacacaaagcacttaagaccctgcaattgctcaagattttcctctagggatccttgttttctctagagctttagattgtaatagaaacaccgttgccttcattcttttctcacttattaagctgaaaaagtaatctggaatctttagcctttggagatttggcgataatttcttgatgcaaaatttgtatagacagcttgaccatgattgaaagaccacatgaaaaaatccttgaaattgaaattgaaatccttgaaactcaaaattctaggactggaaattcttatcacctatagatgctttgaggttgaattcaaagtgtcattgacccaggcactgttgggagtaggaagccttttttcttagggaatttgagcctcaacctctgtctgcactttgcagcattggctgtgatggggcttgtcttggctgtgatggggcttgtcttctggttccatgttctggacaaatgcttccacctttc

SEQ ID NO: 16107 - DNA, 1499 bp, Homo sapiens
gtcctataccctccgggctggggagagtgccctggagctgtggggtgggcccgagccagggacccagctgtacgactggccctacaggtttctgcggcgctttgggcgggacaaggtgagtgggaagctgcatcagggcaggttgagagaaaggataagctacgaacaaagaggggtgagaagcagcgaggggatgggagagaccaggagagggagatggagtgaagcaaagaatagagtgacaagatggcagaagtggagtagaaggaaggagaatgagaagaggtggagagaccgtagaggggtaaacagcgtctgaactagtgcctagctccatccttgaaatggtggcagtgagcaggaagggcctggagaggggagaggagagagccaagtctctgcctgtaggggaaagcacagagggcagaggaggctccagcagttcccatgaagggaagctggaggtcccagggcttgggttagggatggggtttaagaaagcatccctagctgggcgcggtggctcgtgcctgtaatcccagcactttgggaggccgaggcaggtggatcatgaggtcaagagatcgagaccatcctggccaacatggtgaaaccctgtctctacaaaaaatacagaaattagctgggcgtggtggcatgcgcctgtagtcccagctaccagggaggctgaggcaggagaatcgcttgaacctgggaggcggaggttgcagtgagctgagattgtgccactgcactccagcctggagacacagtgagactctgtctccaaaaaaaaaaaaaaaaatgcacccctgccctgtggcctggccaataacctgctttctccctggtccaggtaaccttttcctttgaggcaggccgtcgctgcgtctctggagagggcaactttgagttcgaaacccggcaaggcaatgagatcttcttggccctggaagaggccatctctgcccagaagaatgctgcacccgctacaccccaaccgcagccagccacaatccccgcgtcgctgccccggcctgatagcccctactctcggccgcatgactcactgccgccgccttcacccaccacaccggtgcctgctccacggcctcggggccaggagggggagtatgccgtgcccttcgatgcggtggcccgttccttggggaagaacttcaggggcatcttggcagtccctcctcagctcctggccgaccctctgtacgacagcattgaggagaccctgccccctcgacctgaccacatatacgatgagcccgagggagtggctgccctgtccctctatgacagcccgcaggagccccggggtgaggcatggaggaggcaggcgacagctgacagggaccctgctggcctccagcatgtccagccagccgggcaggatttctctgcttctggctggcagccaggaactgagtatgacaatgttgtactaaagaaaggcccaaagtgacagaggcagcagagggatggtc

SEQ ID NO: 16108 - DNA, 1100 bp, Homo sapiens
gctatgttgccacgtgggccttgtacttcttggctcaagtgatcctcctgcctcagcctcccgaagtagctgggactacaggcatgtgccaccacacctggctcctgtctgctttttaatgccccacagcacagctgggaccaggccaagaggtttatgactgctaaatcaagggccaggggaaacagggagataagtacagatagtaacctgggcttcctctttttaccgggcctggctggtgtttgtaacatggcactgtgcccagcttgggtgtttttaactctaaggaaatactacactaaaaataatggccttgtctgatacaggaacattggttacctaacgaatttccctcttagcattgcccttaccaaagcagagaagtagccattctctgtaagaaaagtaagacttcatggtttcaccacagtgttcttaagattaaggaagttcagagtgaggaatgtcttcaagaaactatcactggaggtgacactgggtctgtctcctgctgcaggaaggctgacatggctggtttacattattggagcagtgatcggtggccgggtttcttttgccagcactgatgagcaagacgccatggatggtgagcttgtctgtcggtaagtgctccccacagaagctctccactctgccttgctggcacttctccactccccgatagggtcctctccacttacagaacgtaatctgaacatgctaactgcccatgagacacagctttcaaggcttttgtaagtgccatgataactctgcctatgatctttactttaaaataaaaaaccagcaataattcagaaaggaaataatggatacggaattaggaaaactaaagcagagattctctgttaggtctttttacgaatagtatctcagagttagtaaaatatggactgcttttgccatcccaaaataagtctaaaaggaaactgcagttctttaaagttcaccagagatggaattacagagttcctacagcctttcaaatctcttggccatacatttcaagttatttttcatctgtgcaattctcattttatcaaaactttttttttttttttttttggagatggagt

SEQ ID NO: 16109 - DNA, 1561 bp, Homo sapiens
cagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaa

SEQ ID NO: 16110 - DNA, 1204 bp, Homo sapiens
cccgcagcccagcgggaagagcaaagactgcgtgttcacggagatcgtgctggagaacaactatacggccttccagaacgcccggcacgagggctggttcatggccttcacgcggcaggggcggccccgccaggcttcccgcagccgccagaaccagcgcgaggcccacttcatcaagcgcctctaccaaggccagctgcccttccccaaccacgccgagaagcagaagcagttcgagtttgtgggctccgcccccacccgccggaccaagcgcacacggcggccccagcccctcacgtagtctgggaggcagggggcagcagcccctgggccgcctccccacccctttcccttcttaatccaaggactgggctggggtggcgggaggggagccagatccccgagggaggaccctgagggccgcgaagcatccgagcccccagctgggaaggggcaggccggtgccccaggggcggctggcacagtgcccccttcccggacgggtggcaggccctggagaggaactgagtgtcaccctgatctcaggccaccagcctctgccggcctcccagccgggctcctgaagcccgctgaaaggtcagcgactgaaggccttgcagacaaccgtctggaggtggctgtcctcaaaatctgcttctcggatctccctcagtctgcccccagcccccaaactcctcctggctagactgtaggaagggacttttgtttgtttgtttgtttcaggaaaaaagaaagggagagagaggaaaatagagggttgtccactcctcacattccacgacccaggcctgcaccccacccccaactcccagccccggaataaaaccattttcctgcaaatgggttatctgaagcggggcgggggatccgaccaccgaacacccctggaaacgagcctgcccgtccccggccgggcgtggccacggcaggtgcaggcgcggcccgcagcgctggggcccccaggaggccgcgggctcggccccgcgggaggcgggcgcgtccaggccgggcggcccctccctggcgcgggctcgggtttcctgggctcgcgcggcgcggcccgtgctacctgttggggaagaaaacccgagcccccggaggggccggggccggggccgggacgtgcatccagccgggccccgggccccaggccccaggcccgaggcgcaggcgagggccctgc

SEQ ID NO: 16111 - DNA, 1264 bp, Homo sapiens
agctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctacatctgtcttttccttatgagccaccagacctgggtgaacgagacaagccatatcaggcagagggaagccctgggagcaagggttccaatgcaggggccgcctagggctggagggctggagacacagccccgcagtactctttcccccaagcctgggccacagaagcaggggctgtctagacaggggcctgtctgcctctccttcagggactctgtgatgggggcaggaacccttgtgtttggggccagagggaactcacacctcagggaggaggctggtagagaactggctgggaggaaagactgccccagccctccaccaaatcccaacgtgctcgccttggtagccaagctca

SEQ ID NO: 16112 - DNA, 2315 bp, Homo sapiens
ttctgagtaacagctgaaaatggccttgttgcctgtgtagagcaagttacggtggtactgccactctgcaggtggagcgggtgactctgggggaccattaagacctccagaccgggtgcggtggttcacacctgtaatccaagcactttgggaggccgaggcgggtggatcatgaggtcaggagatcaagaccatcctggccaacatggtgaaaccccgtctctactaaaatacaaaaaaattagccgggtgtggcggtgcacgcctgtagtcccagctactcaggaggctaaggcaggagaatcgcttgaacccgggaggtggaggttgcagtgagccgagatcacgccactgcactccagcctgttgacaaagcaagactctgtctcaaaaaaaaaaaaaaaaagccaacatgagctgcagaaaccagcagaagcagccattatacttctaagctgtgccaactaagtggttcccatttctggagccagagatgataattaagtcattgcaagttgcctgaagagaattactcaggcaactgggaaaggcagtggaaggtctgtgaagcaaagttttcaagtagatattgctattactggcaggtgtgcaaggcgtgtagtaaaatcagtttgtggcataggtcggcccttgctgactaaatcctctctggggattgaattgatgacgactgtgacttgagttggattcgaaaatggcttcccttggcctcttgaaagagtgcagatgaagccttttccgtggatttcagtaactttccagcataccatgacgatttcttccccaaatatacacatgctcttttgctctttgtgcctgatcttcagtaatttttagttttttaacaggcagaaaaaatctagcagctaggaaagttcaagttggggtgggagtttttagtgaacttttctcccaggtgtgtggcctttatttctatttatatatgtttgtaaatggaattaccccctttctcttgcaaaataaccgcttcctggctgttggctcactttgctggaatttttctgaatccaggttaagatttccagaagtcagctttggaaaacgtgacactcctaccaaagtccagatggttagaaagttatcacataccatgggtttcagtgtttttggaaacccgtttttttctggttttttttcccccctctccattttagaatcttctcccagtcccttcgggcctagttctgtctcatcttgctttattgggttttaaaaaccggtcttatttaagcttttctaatttgtatttatgtacttatttattttttggtatgatggcagggaggggacaaagcagaaataccccttttatatgacaatgtgtgagaaaagaaactttagcttaaaactccgtaaaatgtgctcacttcagcagcacatatactaaaattaaaatgatatagagaagattagcatatagaaaaaaagaaaaaagatttccttaaaacaagaaaaccaagaatgtttttggtttgttgcggtgcccagccgaggttgaggagggatgggtattgttggtgcactgctggtttcatttggagtgtgggacattagggtgagacaaggacctggaatttaaaaaccacagaatcaaacactgtgaaccactggtctctggctaagcagatcagttttctgattttccttggaagcgttttgaatttttctgttgaagttggatttcctaatactttttttctcttagataatcagaacaaatggttgaatacattataatacaaaaatttcttcactttttattcttggttttcttgcctcgtttttcggttttaatgccaaatgattgggtcatggggtgggaaataaaaacaactttgtataaatttgtagttgtgtttgaaataatgttgtttatttattattatattgatgtaactctttttcttcagagagctgcagcacttcctagaaacactcattactctgcttgtaagttgcaactccagtgttagtagccaggtaatttcatcatcagctgggtaagaagacttattgaaaaaaacagtagccacctcacttctcagacagatgaggcactttgtgtgtgtgtgtgtgtgtgtgtgtgtgtgtgtgtgtgtgtgtctgtgtgtggtttttagctctctttctcccatcagacaatttcttttaccctaagtgagagccagagtgtgtccacttgcaagggcagcctccccaccgctccactattttaacgcttgcccttttttacatatacctcacggggtgtctgtcaccattgaaataccttc

SEQ ID NO: 16113 - DNA, 1254 bp, Homo sapiens
tttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaag

SEQ ID NO: 16114 - DNA, 1212 bp, Homo sapiens
aaaggtaaggtgggggtggaccaggaggcagcacagctcctttccctgagctccaaaagtccccagaagggcgcttgcccgtgtcgggagtgaccagagggccagcaggcaccggcttcgtctttccatcgcttgccaggcagtgtgcccctggttgcaggttctctgggaattgagcagtcagcagcgtgcagtgggagcttcccagcaggaggcagtccgcagtccgcagtcctcagatcaccttgccaggcccgattctgggtacatcatctgtttcaaacaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgggggctgtgctatgtgggatggatgtgtgaggaaccccggttccacttaacaactaaatacaacatcttttgcacccctagaatgtcattttgccctcaaccttggtatttctcctggggcccttttagtcttgtgctgactttctcctgtcctcttccagtttagaataagacaggggagaaaaaggcttttcgagtgtgggacaaggtctgatgtcagtgaacggaactgaagagcaagacatggagcctggctggggctaagcagccccctcctccggatggcacaggctctgctaggttccggacacaggcttctgggggaagggtctcccttggccatcacgggaatggagtccatgctagaaagagctcagtgttgggctgggtttgccagtagaacactgcgttccagtcaccccggtcttgccagaagaaaccagcacctctttcccgtggctcctgtgttcagaatgtggtattggctctggcccagccttctcccctgttacccataattcttgcctctttccataatccgtggtttcagtttgactttgtatataaagttggggttttttttttttttttttggcttgttttttaaataaaccaaagtcaaaaacaaactgagagtgtgtcctccacagctcttcctactctcctaggcttgcccgcgtgccctcccacccagcgcctctgctggaccacggtgcagttc

SEQ ID NO: 16115 - DNA, 1139 bp, Homo sapiens
gagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagtgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtac

SEQ ID NO: 16116 - DNA, 2200 bp, Homo sapiens
tttccagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtatggagctgttttccaaggcctttggagggcatatggccttctggctgacagagttgatgggcccaagcccaattactccatttgccagagtaccagagccctgtagggagttgagggttgtttatattaagactcagtctcttaatcactggaatgccttcatcttcaagattttcctgttatagtgttcagtcatttctttgccttgcaggtttggtcccaagcagtaaatctccaaaaaggcaattggaaccgactctaaagccattgtaggaccctcaagtgaaggaccctcatgtaaaagagagaccaggcttgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacacttgtcccgtctcctctttaggttttatcaagcgtcttgttccttggtgcgtccccacgcttccagcttctgcacactttggttctttctcttaaggccacaggagaatatggagagcctgaccgtgtgagctttaagctgcggcagctgctgctccatccaagtggccgctctcactgagctcccctggggaggactcattctttgaatggcctccctggttttagcagtgtgccattgctactgttttccattgcctgggctctgtaagtggcctaatttcttctgcccatgtgattgtatcatattttagtctggcactggtatttctcagcccctc

SEQ ID NO: 16117 - DNA, 1150 bp, Homo sapiens
atttgtatatttctggtgtaatgggcaatgagctcagtcgtatttgcagcaggcccagcttacgacatgcctttctccatactgcattcccgtttggtctcatcatccttacactcgatttcatgatcgatttatatatttatgttattgaagttattctcgtaagcagtctctaattctgtatctatgttggagcaaagcagggtaaaattaaaaatctacataatactgtcaagagaaggggaaaacccagaagtgtcgtaaccttcagggcctgattctcattcagatgattttatgataaggggtttgtagctgttgtgtagcatatgcaagatgccagtatacagatacctacagttagggaaatccaggtagctcaagccaaatatcttattttaggatcactttaggtgaaggaagcctcattggagcagattgctttaaaatctttttccttctaatttcaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtaagagataaaaacatttgctttctagaccagaagccttaccttctgtcttacctgttttaggctgctggaacagaattccatagactgggtggcttataaacaacagcaatttgtttctaactgttctagaggttgggaaatccacgatcaaggtgccataggttttgtgtgtggtgagggcctgattcctggttctgagatgaggaggtcttcttgctgtttcctcacatgatggaaagggggtgagggggctccctgaagtttctgccctcatgaactaatcatccccctgaggccccacctcctaatagcatcgcattggtgattaggtctccaacatacgaattttggggggccccagacattcagaccataacaccatcatttcatggcttcacgacgtttggctttagattggaatttaaggaactgtaggaactagattctgtgccatgttcatcatggcatgaacagttaaa

SEQ ID NO: 16118 - DNA, 1418 bp, Homo sapiens
acaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcattttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtga

SEQ ID NO: 16119 - DNA, 1198 bp, Homo sapiens
taacctttgcacgtactcagtcattggtgtctttggagtgacatctgcagccagttagtgccacctgagtacagcactcgtacttttacatgatgtgtgtgtgagtagctcttctgtccaaaccatgatttgaggttcaactacctgtagatcaaagctttattttagaacgataaactgattttttccaaatgggtgaaatcttctccccatgactatgttttcttaactttgcattgaatctatttactgggttacattctatgtgtagtttgctttcttcatttttttttcttttaaaatgctcatgtcttattccaagcaccttcctccaaagtccccataaagctgcatctccaacacattgttatgccaataaggttttatttaactttatttaaggatgattgtgtctttgaatgacaaatgtactgctgcttcctacctgcaagacgaacaatgtatgtttcaagggtgagcaagtgttatttcttaaatttctcaaatgcctgtagtaactattgtttctgcctctcaattgttgccagctctttgaagaaggggagaattgtgtgtttttgtgtggggatgtttctgatatgctgctacagttgcaaaacactggagctagagaaaataaagtactgatcttcgaagtgttgtgggctctgtggtgggaatcctgaaatgagaagggagtggatggcaagaggggacgtccttcacggggcctatgcttgttcctcttgagcactaaggaccaaggtctgcagctttgataggaacagcccctgcaaccccatttccccagggcaagcagattgatggtggtgtttgcattgtcttgctgggcaggagcgggagccctcccactggcttggctcaccatgctggcgagggtggcacttttctttctcattgtgagagcctggctgtgtgtggcaggctacaagtggttctttggaacgtgctgtgctcatgcctgttttctctgtcttacacctcagcttaagcaagagaacgtgacctcttttggaggtgggaggagggaaggtttggacccctttgagaagccagggatgactctgatgcttcccacaagtttgaaagtctgagcacccaccttcagtatgaccactgaagcccttggcctgccatggtcagggtcagaattgaggtcaggcctgagacctggcca

SEQ ID NO: 16120 - DNA, 1183 bp, Homo sapiens
ccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggtgcggcacggccagaaacacaggggggcgggggactcgagcaagggggggagttggtgcgcccagaaagtggagaccaggggtggtgcggctgcacgcagctcttagggatagggcttggctccttggccactgtgtgggaggggtggggcacttgaagggcgtgagtgcgggcgccactgtagtctgggagtgtgctccgtgctgctgcaccggcgttccgcattaaagctgcccagcccttgttgggtgggggaggggaagacgtgggaattgggcgttgcctccggcctgcagtgagatcagctctctactgacctgcattaaccacaagttactttgcagcaactatcggatcatctagttaataaatagtagagtgaacaactctcaattaattctgaaggattactgtgaccagcatgctttatgactagttttac

SEQ ID NO: 16121 - DNA, 1143 bp, Homo sapiens
caaagatcaaccaaccagtccccttatttagtaaataaggaaattgaggctacacacagaaaattgtgctacagattattactaataacccagcttgctaaattaggctatacctaggtaatctctagaagacaactctgacagactctttaatatttacccctggttggaacaatatttgaaatgtcccagatatttctatgctacttagatatttgtggcaaagcagaaagctttttgactgtgaaggcagaggtcagcactgggggaaacttgctggtggtctctcccacaaccttgcccagagtcctttccactaaggaggtgaagagaacagagaaagagatttccatttctgctgccagagctggtatttgcctgcctgattctctgtgtttcctgtttcaccgccaccctttcaggagagaactacaccagttcatcatgagggtcagggaagcaaaagctctcagatgtgtccagggcgttacttaagaaatgagtatgcagattctggaaggggtgtggaaaaggtgatcctttacccccacccaggaaaacctgcattgtgctagcatggaagaatcatgggctttggaattaaacccatttggtggaattaaacccatttggtttcaaatcccagttatgacatctgttaactttgcaaactcacaaaaattatttgaaattatctgagttttcattttctcaccttccagaatggggataatgcctcctgcatcggttgttgtgaggtttcaatgagatgaaatatgggaaagaagaggtactcacctgatggtccctgctttcctctgctaggcctgagtaggaactggaactctctaagagcattactcatactttttttttcttccaaggtagtttggaatgtgagtgcaagttagttctgcacatacagcccttctccaaatggtggtttcctttgaggtcttttacatgattatttatgactagagacaaacttaataagaactcaagaggattttaaatggagagaactcaagctgtagagaaaggaggaggcaacagacaggatatgtaggggcttacctagagcctggcacgacttctgagaagtcacccagcagaccggctagaggggatttgtgtgccaca

SEQ ID NO: 16122 - DNA, 1811 bp, Homo sapiens
aacaacgataattctgcactcctaagaagttttacttgaggatgctgtcaactttgctgatagttttggtagccataaaaagaataagcagaaaacccagttaattagtaccgtatttctggtttattctagtgattgagttgatgtcaacagcccctgtcccttagtttaaatctgcttttgaagtagcttcctatggtttaattgccgaatcattttacttgaaaacaatttcttgttctgcttgtttgactgagtgtactgtctattttcacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatggagaatctggttttctttttctttttaacctacctcttgtagccaatattttgtgtcatacctttgggcacagtgaaacaaaatgggttttcattgtttattggtatttttgttaattatttttaacaagtgttcttttacatgcaggaggagaggtattggttctctatgaacatattttgaatataggttttattaaggatttcacaatctataaatgctactagtttttttttttttttttaccatcatgagggtattggatacattgtgtctctatttaactcattatgtgttaatgaaattgttgtaaatgggaaccaaatttgtagaacttaatttctactttttagagtgcttaatttcatttttgccttactaaatagtcaaagacttataaaacatttttaacaagttagaacttttttgttattcagtcatataaaatagcagaaaactaacatcaagtgacactgcactaaatactttttttgtattttactgctatcaaatcagaatgaaatatactttaccataga

SEQ ID NO: 16123 - DNA, 2573 bp, Homo sapiens
gtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcaccaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttttcctgtcagtatatcatttttctgtcgcacctgttgcctgggagtttcaggcgatgaggcctcctcgcctacacacagccttccagtcatctggcttccccagcagtggagttcctaacagtgctcagggtgtgaacggtgttctgtggggacagtcaccgcagtgtgagcattcgtgagtgcctcgggactgtggcattcagagcatttgcctccaggtagtggcaggagggcgctcacgggaggagtgctcaggaagtacaggagagaagaagagtgtgccctgatggaaatgacagtgggacaccagtgaaagtggatccagaagg

SEQ ID NO: 16124 - DNA, 1793 bp, Homo sapiens
gctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgagggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccagaactttctgactcacactagtccatcctctaccatcacgatgactttcaaattgtgctctgcagttctgcagattttctagcagtgccatctccaaaatgtgttttaaactctttatttttttaattattattagtattattttgagactgagtcttgctctatcacccaggctggagtgcagtggtgcaatctcagctcactgcaacctccgcctcccaggttcaagcgatttcgtgcctcagcctcccgagtagctgggattacaggcacccaccaccacgcccagctaatttttgtatttttagtagaaatggggtttcaccatgttggccaggctggtctcgaactcctgacctcaagtgatccactcacctcggcctcccaaagtgctgggattacaggtgtgagccaccatgcctgggctaaactctttaagtctctagtaaatgcagctagattcaaatgggctgataaccaaattttaacacatcagcattcaccaccaggtttacttttattttcagattggctcattttgtgcagaccttagagcaaagtttcctttatggtatctgtgtacgtatccaaacttcttttaattgttcacagattttaaaagcggtagcaccacatggttgtgtagatcagacctgtgtatttagatcagacctgtgtatcacgtaagtgtgtgagtgcagtgcagatgagcaccatttagttatatgtgctaggcaaatctccaacacagttgatgtgtagtcttgtggtagatttgtgcatactgtaagcaaattgcttagcttctctagacatcagtttccacatctgaaaaataagaagatgagagtacacggttgttatgaacaaatgacttaatgctttttaagcacgttgcatgacatctggaacacagaaagccctcaatacattgaagctcttaggattttcacgatgttcctgtctgctcaatgcatgctttctttattgttctgacagttgtgtggtaacaagctaatatgcttccagttgacttccagtctaccctggtgttagaaaccgtttcatctcttattgtaaatttgagtgcttgttgttttttatatttgtgatgactcttccagcagttgttgacaattgttagaggtttgacttttaaataattacttattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtatacaaagtaaaatgtta

SEQ ID NO: 16125 - DNA, 1105 bp, Homo sapiens
tgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaa

SEQ ID NO: 16126 - DNA, 1583 bp, Homo sapiens
gccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaattatttcattctttatattaaacttttaaaaatgttttttattttcaccttagatatgggaagagttttttttttttttttttttttaacaggataacttgagcaggctaggcctcttaaaaaaaaatttgagctaaaactcatttttcttttggcattttcttttcaatgttcttataagcaaagttcatccatgttgtagcatgtgttcaactttattttttcatcgggtaatattccattgtatggaatggtagtactacattttatttatcatgcatcgattggtggacatttggatcgtttctacttcttgactattatacataatgctgctaggaacttttgtgtatgagtttttgtgtggacatatgttttcatttctctttggtatatgcctgggagcagatttgctggatcatatgaaactctatttaacccttgagggactcccaaactgttttccaatgtggtgacacaattttatatcccatcaacagggcatgagggttctgatgactccacatccctcagtgctttttattatctatcttttaacttagccatcctagtaggggtaatgtggcatctcattgtgattttggtttgcatttccctgatggcgaatgatattgagcatcttttcatgagcttattggccatttgcatatcttcttaggacagctatctttagatcacttgctcattttttaattgggttatttgtctttttattattgagttgtaagagtccttttatagcctggcacaagtccctttaactggtatatgattataaaatttttctccgtgagctgtttcatttccttgatgatgtcctttgaaatactaaagcttttaattttgatgatgtccaatttttatttattttttcttttgttgtacatgtatcctagaaatctcacttttgatactgcccttaggtccatgtaagttcggggttttggctcagggatggggcagttattctgttggcaggaagcgctagtccacgagttcattaattcttccctgaagcccctctcctgcccttgccttccactcaccccgtcactctccttctcattactgtgtccaggctcaaagcagcagctctctgggaaggcccccgttctccagtttctcccacttttgcatccattccacatgcaccatcgttcatgttcccatcacctggagagaccccatttccaacccgctgcagtgcatttctccagggcagctct

SEQ ID NO: 16127 - DNA, 1202 bp, Homo sapiens
gtcacagcacagtggggccacgaggctgacattctctggccttgcacacagtgccccctgagaagttcaacatttatttcttcacgtgtccagaaaattcctcaattcatccttgcctctgcccttcaggagcagcctggaaggaatccaagcaggagtttcatctgcatgggggcactctgcaggccctggaacattgggcctgagtggagatgggagacagaggcaggccagaaggttctctctgcacagctgcctcccttgctctccctgaggctggcctgccccattccccaagggggctcctctggagtggtggggaggattaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagagttgtctccttcccaacacggacccagagagcagcccttccctgctcaaagcctttccgcaccctcctgactgtcctggatgtgcaactggtttgcactgcacaccccacggccatgtaactctcctgtccacatatgataataccattctgcatagtattactgactcagtaaagagctatttccaggagtgaggtgtctttgagtcctttctgcctgacttgggggcatgatgccttcagggctgcactccaggtgggcctctgaaggagaaccagtgacgagggtcccccaaaaattcaatctcactggagttgggtctaacctcattttagaaacactgagttcggccagggaccaagagcgtctgagggaattactcagagagagcaggaacagagggggaaatgctaagcccaatgcatcttgcagcctggccctggagctctttggctaaaacaagattggaaaacagggcaggcctggacatgtgagtgatacctcctgcttctggctt

SEQ ID NO: 16128 - DNA, 1299 bp, Homo sapiens
gacctggtcttttataaagcccactcttagaccaggattatctaatgccacatcagaagcaaacaggcaaatttaaacttgggcaagtaatttctgtgcccaatttgtaaagggaattcctgaatttttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttacctgtcatcagatttaattaaaattatacttagtaattgcactattacttagttaatttttgttgtatggaaatattggtagtactactttgggaacctgttactgacaattgatgtcattaacaaaatgcctagttggattagatgttttcattttctaattttttgcttgtttaaaatgcaccttacttgttctgagatacctggcaaaagtctttacaaaatgtatggtaatagaaccaaggttagtaaatatacataggctggtggatgagagaccatggaactgtgtaaatacacttaaatgttcacacatttttctagtgtaattcttggatactttaaaaagcaaaacattgttcaaattgttttgattctgaaaaatcattcaactgctaactggcaataagactctaggcaagtcgttttccagattgtaattatatgtagaaactattcatctgcattcattttatttgcctgtaagttaacatgtttccaaaatttaaaagcctgggtccccaaaagaatgtggaagtattaaaatgtatgtaattatgcaaacattttaatgctattttctgcacttatttcttttaaatattttatttaaaatttttaattaacattttgtttgcttaatgcttttgttatgaatcaattaaaattctttattttatacaactaaatctgattttaattattttattatgaaaatagtatatgttaaataaaattcagataatacagaaatagagattgccaaaagaagaggcttcccggccgggcgcggtggctcacgcctgtaatcccagcactttgggaggccgaggcgggtggatcatgaggtcaggagatcg

SEQ ID NO: 16129 - DNA, 1115 bp, Homo sapiens
tccattcacctagactgcaagtaagaagacaaaatgactgagaccgtgtgcccacctgaacttattgtctttacttggcctgagctaaaagcttgggtgcaggacctgtgtaactagaaagttgcctacttcagaacctccagggcgtgagtgcaaggtcaaacatgactggcttccaggccgaccatcaatgtaggaggagagctgatgtggagggtgacatgggggctgcccatgttaaacctgagtccagtgctctggcattgggcagtcacggttaaagccaagtcatgtgtgtctcagctgtttggaggtgatgattttgcatcttccaagcctcttcaggtgtgaatctgtggtcaggaaaacacaagtcctaatggaacccttaggggggaaggaaatgaagattccctataacctctgggggtggggagtaggaataaggggccttgggcctccataaatctgcaatctgcaccctcctcctagagacagggagatcgtgttctgctttttacatgaggagcagaactgggccatacacatgttcaagaactaggggagctacctggtagcaagtgagtgcagacccacctcaccttgggggaatctcaaactcataggcctcagatacacgatcacctgtcatatcaggtgagcactggcctgcttggggagagacctgggcccctccaggtgtaggaacagcaacactcctggctgacaactaagccaatatggccctaggtcattcttgcttccaatatgcttgccactccttaaatgtcctaatgatgagaaactctctttctgaccaattgctatgtttacataacacgcatgtactcatgcatcccttgccagagcccatatatgtatgcatatataaacatagcactttttactacatagctcagcacattgcaaggtttgcatttaagttaaaaaaaaaaaaaaaaaaaaactaaaggtgaaagatgccacattgaacaaactaaattcccaacccggttctggcaaagaatccagttatcccttccatgaagacgcacataactctcttacttggtctttccattagggacaacataagtcttgttttacatcaaata

SEQ ID NO: 16130 - DNA, 1207 bp, Homo sapiens
ctctaatatatacattttatgtcactctcagtttgaaagctccaatgtgtctttgccttaaagaattttgacttatctttgatttatagagtttgtatggcaactctcctggcttccagagcctaacagacttacttgtatagcttttaaagctaatcgattggcttttgatacttttgctggaggaatatcttattaaaatcaaatggatgaagtagctaattgtatttaacatttgaagggataagtgaaaagaggaggaaaagactcaagttgattcaaaagcaaaatgagaagaaaagataattggcatattctccacatctttcctctgatcaaccacataggagacaaaacaaattagagacttgtctttgaacaggaagcagatgtgccgagcatatttttacttcagattttgttaactattttatctttagatactgatttttgtctagaggagagtgttggagcaactaaaatggaactcataacttcagctcttgatggaagtttccttgatgcctggcactttatgctgtattaatgccaggaaataaattttatttcctcctgtctttaggcaagctgttattcctctaatgcacagtcacttttaacttagatttttgagaaacaaggaaaaaagatttaatctttgagaccagttgttggctaaggcaggcgtttgagcatcccagttacttgtcattcagcagctgtgtgggaaaatgtaagctacattgttgaacagattttgtaaaggaaaaaatttatttcttgatttatttggtacaaatgtctctttactcaaaaaatctttacaaatggttattgggcattcagtcatttgcttagcactctgtaattttataaagtgatttccatcaggtgcctttcacagaaaccctgaaggtcaggggaaatcataatttccttgatgagaaagctgaggcatagagaagctccttgttaggaggctttgcctctgatttcctggtcagcttcataggttttttgcttttttatttttgttctttttaacttttttaatatccttgccttactgctgtggagaatgatttctattttgcaacagcttatgtttttctcctgtgtacagggatattccaatgcctttagttagctcaggagtagagcatggtaacctgagagagctggcacttgcaagaatgaaagacctcgg

SEQ ID NO: 16131 - DNA, 1177 bp, Homo sapiens
cagatatttactaaacatctcctctgtgctggcccaggatatacaaagagcccaagaacctgcaacttaacagtctctgtgggaaattcttaagtcataggaaggtttaaaactccagtgctcaggaacttcttagagctgctaaagggataaaccaggagtggtgttgagaccaagggccgactcctgggctctgccttcatagattctggatcagtagattgggatgggacctatctgtttgttatccagcactaggtacatggttctcatgcacaattcagatttgggccacactttgaaagacatggttccaaggattgcatatggtgtttgtggacttaacctaagacattttattctctcactcaaattattagggagaaaatgtttcagaagattgttcaggggagagtttgtgaatattattggcatattctaccaaaaaaaaagtgaacaattttatgttccagaaaaatagcaaaggacaccaaacaagattgtgtgcctgctttgcctccaaggctccagctgtttgtgttctccatctcctctcgcctccaagaaggccactgaccttcaagaaggccaaggtgactgacctggcctggttatcccaacaatctcgttatccatccatcttctttaaccctcacccctcataagccttgttagcctctattaaagtaagctgggattgagtccaaaggctggaattcagtcatagccaaaatatatctagttcctataggcaacatcttgagcagaaaataagcacacaccaatctctgcctttaaaaaaagcatgccaaaaaaaaaaaaaaaacagaaacagcatgcagatgttcattaagaacatggaacagtaatacattcccatgctagctactatatagaactattgtagtgaaaggacagcagctacattaagtagattaataattacagagattgatcatcttcgtctgctgtacagtttttgtttactggaattcatggactctacatcagcaaagcattgtcttgagctagttcctggggtgtggaagtagctttagttttctacaactgaataatgagctcttatttttctcttggaattctgtacatatatagcagtccttcataaaaatactattactagaaaagcttatgtgacatcatcaaatttcccaca

SEQ ID NO: 16132 - DNA, 1219 bp, Homo sapiens
tacatttcagagtgtgcatgttgagatcttgaagtccagccttgccagtgtagacacaacagcacatttgtagactttttgtccccattcttgttcctcttagtttatggatatagggaatcatggtcttatgcttttgcttaggaggaatagggttatatcatgtgattcctaataacattcctgaaaggtctggaagctttgagatgaatgactacctttatttaaaattagacacttcacaggcttttttctgaggaagcaagccctctccaaaagtggcccaacctatgctactcactaccagctgtctatcagaaagtctgttttaatagtttgttgcaatgttgactccttatcaatgtaacttgaatatgaatagtactgttcttttctctaaatatttgacattgccttaattcattcaatttgataaagcttttctattttagatctgttagaggcagagatttggcaggttattctttgggtgaacaggtattactgaataatgctggaaaatattggtgctgccttccttagcagcaaccaagatactagttttgtggagccttttagtttagagatttctaattccaacagaacacatgcaaggaatttcttattctttagttggcctggcttaagctgttgtctctgaccaacaactcacatttctaagacagtgcctgttagacatagaattgtagtttgtggccatgggatcatttccttatgcaccccatcctctagtccctaagcagaccactgtccacttgtccaccattcatgaataaattgctggggttcagtaaagcagtccacatgccccagatctctacctgcgtgatctgttgcctcactgcaaatcctaataattagtgtttgttctggttatttattataacataccaccccaaagtttagtgacttaaaacaacaaccctcttatttccttaatgattctgtgggtcagaaattcagcagggcatagaggggatggttcctgtctgttctgtgatgtcaagggcctcagctggggtggcttaaatggcagccagttggctgggatggtgtgtctgaagtttcagttctgactggggctgtccatatgagcagcttggttcttgtccacctgtctgctccatgtggcttgggctttttaatagcacaatagctggggttctaagagggaggagcaaaggcctggtcttagaag

SEQ ID NO: 16133 - DNA, 1622 bp, Homo sapiens
gtgtgtgtgtcacataccctgagcttgagttaaaaatcagggaaagagtcttcttctctccacttagcagtttctatattttaatgcagcctgaattcaaagtaataatgttccaaacttattaagctgagattttatgtgggagagaatttggtctctgggtgggagagagtgtaaggctgagggaagcacatgccgacttttgagaattgctaaagtgaatgctccttttttaacttcgatttttctgcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctacttt

SEQ ID NO: 16134 - DNA, 1142 bp, Homo sapiens
cccttccacccgtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgatttaatgtgtgcctgtcctttgccccttcccttgcaacaaataagattatcactgtccttgtccttggtgttacacaaatggtagcatatcacactgtagcaaagtatgacgttgattcacttatactaacagtaggtaacgcttcccaatgactaggccaagtgtatacatgggttccctattataaataaccctatgagagagtgctgttattgttcccattttgcagatgagaagagtgaggcacagaggttcaataacttgctcaaggttataaactgggaaataacagcactccag

SEQ ID NO: 16135 - DNA, 1099 bp, Homo sapiens
tcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtg

SEQ ID NO: 16136 - DNA, 1194 bp, Homo sapiens
ccactggaaaggtaaatgattgcttttttatattgcatcaaacttggaacatcaaggcatccaaaacactaagaattctatcatcacaaaaataattcgtctttctaggttatgaagagataattatttgtctggtaagcatttttataaacccactcattttatatttagaaaaatcctaaatgtgtggtgactgctttgtagtgaactttcatatactataaactagttgtgagataacattctggtagctcagttaataaaacaatttcagaattaaagaaattttctatgcaaggtttacttctcagatgaacagtaggactttgtagttttatttccactaagtgaaaaaagaactgtgtttttaaactgtaggagaatttaataaatcagcaagggtattttagctaatagaataaaagtgcaacagaagaatttgattagtctatgaaaggttctcttaaaattctatcgaaataatcttcatgcagagatattcagggtttggattagcagtggaataaagagatgggcattgtttcccctataattgtgctgtttttataacttttgtaaatattactttttctggctgtgtttttataacttatccatatgcatgatggaaaaattttaatttgtagccatcttttcccatgtaatagtattgattcatagagaacttaatgttcaaaatttgctttgtggaggcatgtaataagataaacatcatacattataaggtaaccacaattacaaaatggcaaaacattttctctgtattcattgttgtatttttctacagtgagatgtgatcttgccaaagccaccagaccttggcttccaggccctcctgtagtgagttgattgtctgcacttgccttgcccaatagccagtaggctacagcttttgccccacacccttattttcagattctggatcattcttgtttacaactgaaatatatataacctcagtccaaagtggtgattgatttgagtatttgaaaattgttgtagctaaatgaagcatgattagtcttagtatgaatatcatttaatctttaaaaaatcaagtaaaaatgtttatctgataatgtttaaataatttacaatataaactgtaaaacttattaggcatgaaatcaatcagaagagaaagaaaaatgctggaacatgcttgatgtatta

SEQ ID NO: 16137 - DNA, 1055 bp, Homo sapiens
catcacactatgagaattgtttgtacacatttataatttttttaaagtatgtaaagtaaggattttttctccattcttcactcacaaaggatagcatttttatggaacctagatttacaaaggaacttgtgattcttttcaatgcttttgtgtcgttttacagctgattaagaaaaaatgtttacatttaattcagctgtatttcctagtagctgtataatcttacacattattcttatataattttgacctattttatatgaaaataattgtattggcatctcttcataatttaattctcttctctccttcttttgttccgattagatgaatttgggaaaggagtaggaagactaggtatcgcatgccttccgtctgattgtaatcagtctcctgggttttttactaatttaatcttaatcctgtgcttctttagtcatcaaattgatataggattacaattttctctcaggatccaagtcttctaagaatgaaaatgttgaagtctacccagaaccagccatccttgtagacatttctatttggttgatttataaagatttaatatataaagatttaatatgagttaaacatgtttcttattctgtgatctctaattagaaagtaaaattctgttgccataaatataaaagaaagttttcacttatattttagtcaaacaccaaaccactgcattacttacttcctataagacacagtagttcaatctgttgaaaggcattgaaggataatttccttcagattactttttaaatcatcatctgcctcaggaaattctttcttgaatttttttgttggtgtgaaagcgttgcttatactttatgctcattttattggtcactgtcaccagtttttcccgataaagattaaaaatgttttttaccttgaaataattcagattttgaagattcactgtttcattattttgctaattaccattaactagtaaagttagtttttaaagtttttttaaggttgatattttatcatattcctggagtaggatggattactttattattattgtagcttta

SEQ ID NO: 16138 - DNA, 2202 bp, Homo sapiens
catggacatctttgtcccatgaatttagttggtcatcgtgttacagggctataatgccgctctagatccagttaaataagaagtggggaggggttgtaaactgcagctttttggggcacttatccatttattaccccaagtaaaagacctataccaaacagcaaacaacatctctgcattgtcattataatgttctttgagacacagccagtgttccagccattgttccatctaagatttaagcattttctagaaatgtatggtggcaggggtgttgaacataacttcttcaagactgacatggttctctttcttttgcaggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccgactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtcca

SEQ ID NO: 16139 - DNA, 1099 bp, Homo sapiens
cgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtaatagagaaacgaacagttcgttttggtgcatgaaatagtatttcactcttaatcccttttccaacttccttcactttagcaatcgtaacttctagcagaggagaatacatgcatactcatgaaaaacctgtatagattcctttcttcctgaagggtttgcttgctgctttttcaagccttggcagttctgtggctgttactcacttcctaaatcgaggatccccaaaactgaaactgattttatattcaatatacaaaaccttgtcggttatcccgtagacttccatgtcataacaagatgatgatgataatgataagctaccatttaggaagcacttagcctctaggcactataataagcattttgtgacatattatcgctgtttcttcagcttattcgtatgggagctgaagcttagg

SEQ ID NO: 16140 - DNA, 1718 bp, Homo sapiens
ctggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgacc

SEQ ID NO: 16141 - DNA, 1165 bp, Homo sapiens
agcgcattgtgagcgaaatgacttgcatgtgtatgtgggagtatttcattagaagggagtggtgaataaaatacagtgacattgtaagtgtttggaatggcaaatatgcttctgcaggccgggaaggatgagagcctgtgaggagacttcatcatagccctgtcctgaaatgtagcattatggggaagaagattacatagcccatttaagaccaggcaaagctttgaaatttcccatgatttgtctttaatcatttttaacctcatcctaagggagtggggagtcttctcccattaaacataattgctcatttgtttttagctggcaggtacattgtaattaagaactgtgttcagtctcctttcagctccacctgtcgctagttaaatggtactcatctaaggagagaaaccagagagtacagtggaaggcaaggggaggaaattgtctatcaaggttctgatatgagacttataaaattcaaaaggaccagtactatgtagtcaatgccctattttcagataaagattgagagtaaaatcattcagactctgatgtgtaaatatagatacatgtatatatggatatgtacaatatatgttgagtgactaatggaaacataatagaaaaaaattacaacagtatctttccctttctggaaagagcaaaggaaactcaatcacattctgtcttttactggtttcagtgtaaagtcataggtagctttaaccttaatggtgcaaaaaattcactgtggacttcagtttaaagtcagtgagaggagaaagcattagtggccttcaggaggcatcgtagcagaccctattggtagcccacccatatctctcagactttgctgtttcactgtcctctgtcataattccagctgccggtatctgtatggctttgcctgagagttttttcctgaggctgcacaaaatgcagcagttggtatataaacatttcagccccattgctcctcagtgggataactcagagctgtctgtgttagaccatttctgagtttccccatggggataagttccagttgccccaagttgtatgtggctcagtgccattatctgtcaccttcctttgcactgatcacttctccgttctgttttctcagcacctcccatataaactaccttctctcaaactcttt

SEQ ID NO: 16142 - DNA, 1146 bp, Homo sapiens
ggcatcccgattaaatgacacactgtcactgtgggtaagaggaaagagccttcaatgtagcagcacagggtgcgcctgaaagaggcacaactgctgtggattttctgcctcgctccatctctcctatgtataatgaagccttgtttaaaggggcatgtggggctggatgttaagcacggcttctttttgtccgttacctgaaaacaatttctaagataaaaggaaggtgccatttccttacctcttcacccatcctcctccaccaaatgtattcaacttaaaactgtgagagagagagactgaatgaccttcctcagttttccctttctcattcaggagatactgaatatccgccagtttgtagttggtttccttccacttaaggcacacgctgactgcatcatttccttatctgttaatcctgcttatgtgagtgtgaggaaagtctttgagagggcatgaaagtgccaccttatatatgtctgtgactttaaagagctatatgcagggcctggtcccacttttgtccatggatttcagggggaaaaaatatatgtacttttttcagcttccaagcattgaagtgaagtggagccgtctcttctgttttactgtattacttgaaccaacaaattcaagagtagcatttgttattctcaggaatgagcctcccaccgccccccccccaccgactcatattcttttttggtttatctttttatttcaattaggagattacgttctcttcctttccttttattttgcttagaggaaatgtaacatagtcccatttttgtggaattttgacgcttattctcaattgaatcagaaagtacaaggagacagagaaaaaatccgctctgacaagccacatccatgattgattgtaaggggattattataattgatagcttctttatcatgggattgctagtatcatttgtacttgctggtctttttaaaggaacagactgactcaaactgttaagacagctgcagtttctaaagaaatacaaagattgccgtggatgcactcaaaggtttcattgttttaacacctttaagggagaaaaaaagcttcagagaataaaggcaagttcgcatccatgaagggcagtaccagaccctatatggcaatgtggtaaa

SEQ ID NO: 16143 - DNA, 1119 bp, Homo sapiens
ataatggcaattgttctgaatgactgagtgtcctcctgacatgtaattagctgttttagcaggatgtagattggcatggtcataattaaaagaatttctgtcttttatgtgattggaaatggcagcgctcccatcccctgttccctcttagcactaatgctcccaagaacatttggaacagcagctccataaactaaaataatgacatggtgctcgtgttctcccctaagtgaaacagcagaatttggagttgtttcagcttcaaaatggaagcctttgattattgttccccatttgacttctaagttctttgaaacttcactcaacatccagttccaacttgctccacctctggcagaaaccacagtcaggaccccagaagaagcccctctgaccggcccccactgcattccagcccatggtctggccagctccgggcccttgcttgcctaactcgaggatgttgctgcttgctgggctctctgggatcttcagatttcccttggttgcttgatatttccattgccgtcactatcagaaagcatttcccaaacagaagtttacagaaaattgaatcgaggtttcctcattgaatcctaagactcaaagcagacaacatgacaggacacatataactaacacaggctttaaacaggtggaggcgtgaatggagtactattcacgacattctaaagctactggagcacgggacacgtgtctgtacgctcctctcacaccccttactcggcagctgccccactcccgccgttgccgttgccctgagtcttccccactgttctgctgtgccagtgtgagcatctccccggcactcaagtccatgttctctccctcccgctcttcctcctgtctcttccatgctccctgttgcacgggacatcatgtgggcttgatgccgtacacagtccctgaccatggccccctactcttctccagaagtgtcacactagacaggagctgctgagtcaccaactcacctttccctagaatgtgggtttgttttttctcccccatcacttgcagaggtcttttttcaattatatgatcaagaatgagtctacaagaataccagcaccagacatagtgccaaatggccttttg

SEQ ID NO: 16144 - DNA, 1717 bp, Homo sapiens
gggtattcatatttgacacatgggcaaacttgccagtggaatggaattgtgacctgacagagaagggaaggcaggctgacgaaggtgatcgaatgggagaacagtgctgtggtgatcatgagaatgaggcttttctgtagcatgtaaaccaaaccggacccttggcagttcgtcgtccctcagttctccagatgctattttttgcaggttctaccaagtgcttgttgattaccctagttgtaattatctagggaagagatgaatgtaagtgagagtgcagagcactggggagggtgacagtgaaatgcaattagaggcagcaagagagtcctagtctgttctcacataaccggacttgaacgctccagtgcgagcagagtgctgggggtggattccactgccgaaccacggcagctttgctttactcttcagcatgggggtggtaactagctgcacagcaagttatgaaatggaaagcaagcttaacagctgtaatctcatcggataccctggagcaaatgccttgggattgcctgaagtgaagtgtttagcatccaccaaatagttgagtttctaagatgggccatgcgggatccctgccacacgggtgtgggggcagcgcgctcctccctgcctcggctgctgtgtgtgttagtcttcatgtttccccttggcgtctcctctggtccctgtccatcttgtgcaccatgtgtccctgagggcgagtcacacctgtgtcttgagtctgctgtaaggtgttcagtctacctcaaggggtcatcatggtaagctctatcccacggcatcctccgtccatcaccacacacactggaatgtatcccccccgccctgccccttcgataacctcctgaccttgtctttcctataatcaccacaaactcctagtgcaaattggatgctgctttaaatgtgaaaacaattgttcaaaagctataaaacctgaatgaaagctgaagctgaatttataagccttgttgcatatgagccaaaagtgcaaaaagctctatataatgaactaacctgccactcgtataaatataaatatatataaatatattaaaatcagactgttctacaaaattgtgtatttgtatttttgtgtacgtacaattttctgctaagcagaaggaggatgtagtataggatgctgtgagaagagatttggtttaatcctatttctttgttacttatttttgttaacatcagatgcctgtctttgtcttatatgtgtatgacactgtttggaaagctgcagtatctctcttcctgaggtccagaggccattaaagaataaacatggggcttagaggtgtcttggccaccaaacacaggtaagccaacagagttcggctcccgtacgtggtgtggtgggacctggggcctggagccacttgtactcctggggtgggactgagggagggaaagggctcccccacttcaggctggtcactgtatgttgacttccctctgggaagcaaaattccacttgtaaaaatcagcttccaagacaaaagatgatccgatgtcacttctgggtcaccaggaagggacacaggatctctctgaactttggaacagaccctcatattctggggccagaagtttgcccagaaagcagcaggtggctctgcctggctgtagagcccagctcattggctgtccctgggcttcgtctccctcttccgagtagttgctg

SEQ ID NO: 16145 - DNA, 1228 bp, Homo sapiens
gcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgcatcatgtctgaggccagtcttgttgcttctccttcccctcaccccaacatagggttttggggctcctggcaggccatcctgtcatggtgtggccttgttctcagcaaaggtggtgcggggcttttccagactgagactgggaggaggaggatcagggaacagcagcaggccgtgctcgcctccccagcccatggacttcagaggctgaactcttcatgatttggacttaagagcccaggaggccccccggttctgagtcatctttccttgtttggacttcagccccttactgaagccaggaaccatggaaactttctggggcccttcgaccccaggtaagtggtgctactgggagac

SEQ ID NO: 16146 - DNA, 1112 bp, Homo sapiens
agcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttcta

SEQ ID NO: 16147 - DNA, 1119 bp, Homo sapiens
caagcgttttggatgagggatactcagctgggttaattcactggcaagaaattagtggtttctttaatttagccttttttccttagccagaatagaattcattgttttgtagaggagcctgtacagataagagagtaatctgttgctttttcaaagcagagaaaactacttggaactgaaaccagatgataaaaaagtaaaagattaaaaaatatatatttataagacatacacaaagataaaagcaaaatctataaggcagaaatattaggactgttgaaattattatctgtgctcagtcctccttctaccagagagatacaagttgtctgtgattagcagcctgtcttactagctaatagacattcatttatccttcaaattactatgtggcttcaaaggtattattttatattcttactgtgaatttacataatgtttattattttacccttcaaaaaaagtcttctaaactaaattttttttttttttttaacttttctttcacgtcaatgatgacatctgttttgggagctcaggggccagccgaaggtaagagatttggtttgttatgtgatgcttgtaaagatcttatatgcatgttgttgaactcttagaagttttcttctcaaaaaggaaaatattttctatcattttgtacaagtaatgcaagctgtcagcctactcacaaatctgaagccatttattggcatgggaagggccggaggtttatggaaaagctgtatttgcactttgaccacttctggctggtctcctagcagctacaacacagattccttttgtgccatagattggctcaagactggtagttccaaactgtggtcaaagccgactcatcctctctgctcccaagacagctagggatgcattcccagccaacagaaacctgcgcggcctcaagccgcctccatagattggctctagactggtagttccaaactgcggtcaaaaccgactcatcctccccactcccgagacagctgggggtgcattcctggccaacagaagcctgcacagccacagccgcctcaagggaacatgctttcacctctgtctcttagggaatgtggagccctgcttgaagtgggcacaaagtct

SEQ ID NO: 16148 - DNA, 1326 bp, Homo sapiens
tcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaagaaaagaaaaaaaaagacagcatctcactatgttgccaaggctcatctcaagctcttgggctcaagagatcctcccacctcggcctcctgagtagctgggactgcaggtgtgtgtcatcatgaccaatgtgaattgcttttgaagctggttcatgggcatgtaggccaccgaagcaattttagaccacagtaagtcaagcttttttccctccgatgatcactgggtggttgcagcattttttgcataaacctgcctaagacttgtctatcgtctgtgatcaatatgccatattacactaaggtgctcctggaaaattgggtgcagttcaaattt

SEQ ID NO: 16149 - DNA, 1602 bp, Homo sapiens
ccatggtggccccactatagaatgcattctcttttttggggtcctaactgtcattcccagcaaccatgtgtgagtgtagtaggcttgatgattgggaaggttgctgtgggaggcgatgcactgtcctgcttagcccagttccacctagtggcacactctttcctttcctcctatctcattcatttgctgacaataaacatgtatgacttgtaattttataagcaattctaatgcatttttaaaaactaatgtaaattttacccctctcattctaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggggtttagtctcattctttctattagcctaggcgcaaataaatgttactttttgtttttttaaaccctttttcccaaaggggaaagttcatgcagaagttctgtctccctaaacagtaattttatgtggtagtcgtaccttagtcttttggtaaatgttttcaaaaagtaatttacaaatggtgtggaagcctctgccaaaaaatagcgtttgaaaaaaataattaaatctccaagcctcccaacccatcagagattgcatggttacacttagttaagcttcataacctcaaagccccagttttatatcttatgtgtttaatgatttttgccatttaaaactgcagttacttttcaccaaccaataagaaccaatttaaaacaaacccttattaagactattgcataataaaactatcctcttttcatcagtaaaacagtagaaattttaactgatagaagaaacacagctttactttatgtatatcccactaaatccttaccccatttctcc

SEQ ID NO: 16150 - DNA, 1602 bp, Homo sapiens; identical to SEQ ID NO: 16149

SEQ ID NO: 16151 - DNA, 1188 bp, Homo sapiens
ggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggacttttttttgcaggaagtgcattctctggtccttccctattttctgttctggatgtcagtgcagtgcactgctactgttttatccacttggccacagactttttctaacagctgcgtattatttctatatactaactgcattggcagcattgtgtctttgaccttgtatactagcttgacatagtgctgtctctgatttctaggctagttacttgagatatgaattttccatagaatatgcactgatacaatattaccattcttctatggaaagaaaacttttgatgatgaaacaataaagattttaaatatctattttagtttgtgggtgtttttgaaatgaaaatatatggcacactttcattctgaagtgcattaacattctaataaggtgatgtaaagcaagatgacattggtgtaatgttagagttgcagaagtttccattccaaaataaaatggaaaccatagttacagatattacaatgcagccctgtaattttgagctgtagtaaaaggattggtaatctgggaagtagaatttttacaaaatcttttacaaaaatagtcataaaaggttttgttgacatttaagactactactgatctaaaggcaaggtcctacttcttaaattttcagaacatttttatgacttcttattatgtatttattaccactcattattatagcatgttactttttgcaaacattttaaacaaaaaatatttctgtttggtacactgtga

SEQ ID NO: 16152 - DNA, 1198 bp, Homo sapiens
gcaggagaatcccttgaacccaggaggcagaggttgcagtgagccaagattctgccactgctctgcagcctggaagacagagcgagactctgtctcaaaaaaaaaaaaaaaaaaaaaaacaaatcaaaaaatatatatacagatttttttcccaaacagtagattcatactaatttctattttatagcctgctttttaaactttatgtctataagcatttttctacaatgtaattttaaataaccacctaatacagtcacagttgatttaatcaatcttctgctaactttcagattttaaaaattttttatagaaacagggtctcactgctcctcctgccatctttctgcgccgccacaatggtgcgcatgaatgtcctggctgatgctctcaagagcatcaacaatgccgaaaagagaggcaaacgccagccaggtgcttattaggccgtgctccaaagtcatcgtctggtttctcactgtgatgatgaagcatggttacattggcgaatttgaaatcattgatgatcacagagctgggaaaattgttgtgaacctcacagacaggctaaacaagtgtggagtgatcagccccagatttgatgtgcaactcaaagatctggaaaaatggcagaaaatctgtttccatcccttcagtttggtttcattgtactgacaacctcagctggcatcatggaccatgaagaagcaagatgaaaacacacaggagggaaaatcctgggattctttttctagggatgtaatgcagcatatatttacaaacaaaatgcctcacagacaattaaaaaaaaaaaaaagaaacagggtctcactattttgtccaggctggtctgaaactcttggcctcaagtgatcctcctgcctccacctcccaaagcactgggattacaggcctgagccaccacacctggccttaagatcattttgatttttcattaccataattagtaaagcgatgatcatcttctgtctctgactaattccctaggattacaatacaaggagttagtaggtcaaacagtatgcatattttgaaggtgtaaaggggaaaaaaaaacatttttttcctctactcacacatctctcaatacttctgatcaccaaatgtatggttttttttctcccccatactgaccaattctccagcactagctgggtgtcctataattcaattcatg

SEQ ID NO: 16153 - DNA, 1921 bp, Homo sapiens
ctcatgcctgtaatcccagcactctgggaggccgagacaggcagattgcttaagcccaggagtttcagatcagcctgggcaacatagtgagaccccatgtctataaaaaaataaataaataagattgatttattttattttaagatttattttgtgtggggtcctgcaggccatgagattaatcttagctgtacagacctatctatttcctgcgagatcatgtatgacagactggaataagagagagagaataaatacagagtgtttttatgttctttaaaaaattatcttgcaggttctgcatcactctttcttctctcatgctcttgacccagagggtcacgtccctctctctggacatttgtgaggggaaagtgaaggcagcatctggaggcttcaggagcaggagctctttgtctgagcatgtgtgtaaggcactgccctatttcagctacttgctctttttccctgctctcctgggaggctctctgtgctccttccagcgatttcaggctcgtgttcaagggtccagtgctttgcatcccagacactctttctgggctctgagctggaggggtctgcagattcttggactagaatgcctaaacgtggcagtgagcagggtggtggatgcaggagcgggactgactgattgccagcaattcgagtgcatctatgtcgtgtggaccacagctgggcttttcaagctcacctactactcccactggatcctggacgactccctcctccacgcagcgggctttgggcctgagcttggtcagagccctggagaggagggatatgtccccgatgcagacatctggaccctggaaagaacccacaggatatctgtgttctcaagaaagtggaaccaaagcacagctcgatggctccgacggcttgtattccagcacagcagggcttggccgttgttgcagacatttgccttctctgcctggtggcatggactccatccaggacaggtgtttggtttcgtttgctgggccgtgatggtggaagctgactacctgattcactcctttgccaatgagtttatcagatcctggccgatgaggctgttctatagaaccctcacctgggcccacacccagttgatcattgcctacatcatgctggctgtggaggtcaggagtctctcctctctctggttgctctgtaattcgtacaacagtgtctttcccatggtgtactgtattctgcttttgctattggcgaagagaaagcacaaatgtaactgacatctttccctggctttcaccttaaacacccaggaaacattttagaaagtgccagatgacgcatcgataatgcatacatttgaacttttccataataaaattttttctaaagttttggatggatatacccagtgacttgcagtaggaatttgtgtatctactttagcaagctattctgctggtactgaggatacaaaaaggaaaaagatgtggtttcttcccttaaggtttacagtctagatgtggaagcaaagattaagtaaagtgatacataaaaacacaaggtgctatgaaccagatggcaaacgctctatatatagacaccccaaaattgaatgttcagttgacccacctgatcctggaatgggaactttagcaacacaaaaccaaaacaaaacctaactcattatcatattggtttgttatgtggactacagacttatatccattattaggtttgaacttttttttctaaatttggaaatttgggccaggtgcagtggctcataactgtaatcccagcactttgcaatgctgaggtggaaggattgcttgaggcccagggtttgagaccaggttgggcaacatagcaagactttgtctcaaaatatatatatgtgtatatatatatatatacacacacacatatatatatatatata

SEQ ID NO: 16154 - DNA, 1300 bp, Homo sapiens
gagccccagtaatgattgccctctatgttgggagaagaagggagaaagtagtacaagtagtgaagaaaaaaatgtaggtggtgttggtggttgagagtacatggcacagaaaataaaggagccaggattacctgtgcctttggcttctccttcccctgctgctttttcttcctttttccatgtcagtgcttgggaaccctcacaactggcaggtaacggggtcgggataaaatgtaaacctgtgggtgtcttctgctgagtcattaggatctttgtagcaggctgcggataaatatgtggatgacatggggcaactaagagccccttttgcttgccacctcccacccctgctctggatggtgtctcctcttgctagactgccgggtacagatcacgtggcaattaaggcaaatgttaataaataccatgaaacagtggtttgcatagtcttctgaatagccatggctttggttagtcagcaacaaagcctttcacccttaccctggataatcaagagttgacaacagccagaaagtactgggaatagtggcttttggccatgacatctgctcattcttcattcatgtaatgggtcaaatcagaagtaattctggagatacggtatggtaagagaagggcctaaagagtctcaagagattagaaagcatatgccattgtaaggaaggatggggagagacagtgccaagattaaatggactcagccatttgacttaatgggatgcactgcccatggtggcaccctcccctgggagttcttccttgatcttgagactttcccaaactggaatccacttagctctgccacatcggtcccagatttggtgggactctcctctggtatcagttttcaacgccacttcttgtttggagtcattcccagtgcagtcatggactctatgaacaaatacggttatttaaatgtatttgtccagtatgagaatcagaatgaactagtagaggctttacagatcagctggtctgacccattttacagatgaggaaacaggcctgagaagatggagggagttacccacaatctgaaggggctctaccatgactagacccaggtcacctgcctcccaggcctggctctttccactccgaggtgctggctcaccacagacttattctttaatggaattttggaaaggcctcactccagtgactctttggatctttcttctctaagtagatgggaagcctgtaagaagagacttggaggcaaagcaaagggaatcagcacttaaccctcacccaaagggcccaagagaatctttag

SEQ ID NO: 16155 - DNA, 2423 bp, Homo sapiens
ctgagctgattgattgccttctgcatacaccttttctacaacttctcaaacgtgtgtgacatgctggtaagatggcaggaaaaggagtgactgaataatacaatatagctgagatgtgtttcaagaaaacctctgggccagggtaggggtttgtgagcgggagccaaggacttgccccatgtttctaatcaaggtgagaccactgacacatgtggtcagcaaatatgttctatacacacatccgcacactgtcatctaacccatccgttctcccatccacagcatctccaggacaaagccatcgcaactagggaggggttgacacctgctctcctaacatgttttctttctgtttcaggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtcacaccattgcttgacaaattcttttttagcaagaccaactacatgtatcccacactgcagacaagacgccagcagatttcattcccattgtcaggcttcggcagagctaagcaagcattggccattgagcttaggcacaaagagattaaaggaggaagcagataccggggaaagccagagagtaagtctgcaaacgcacaaccacagtggctggtgacccacaatgacaccagaggcagagggacctcaagggaggcccctcatctacctcagcctacaaagcttgactcaggattatctgaattatattaaaatgtcacttgggttttctgctgacttaaatatatcttacgccaggcatggtggctcacacctgtaatcccaacactgggaaactgaggcaggaggcttgcttgatcccaggagtttgagaccagcctggacaa

SEQ ID NO: 16156 - DNA, 1113 bp, Homo sapiens
ggatacgtttttaaacctgatgacagagacagagctgaagggcttcatcgtcccttttgtttgacttagtgcctagaaccattttggcaggtttttgtgcctgctccttcattcccgatggcatctgcatctcaggggaacaaaggcccggggtctggtcagggcgtgtgctgtgccccatgtgtgctgctgggtggcagagcaggagaagggtccgaacctggcatcctcagccactggcatctgggcatgctcagaacatcctggccacaccacccctcagagcagctgttgtttctaattgtttttaccttttcctttaggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttttaagatgttagtgaattctgtttcttttcattctcggaaatggcaggaagcagctccagtctctgatttccatgggtcacgtgctggggatgtgatgaagcctgcagtctgcactgtgttgctgagcacatggatttcaccactggaacacaggtgtgctgcttgttagcaagcagagcaataaagatgtgctggatgtcattgttaatgttttcttttaaaaagaagcgtcagtgtcagccgggcaagctggctcacgcctgtaatccca

SEQ ID NO: 16157 - DNA, 1171 bp, Homo sapiens
ttttttttttttttttgaacaagggtcttggtctgtcacccaggctagagtgcagtggcattatcacagctcactgcagccttgaccttccaggctgaagtgatcctcccacttccgcctcccgagtagctgggactgtaagcacacatcaccatgcctgcctgattttttgtatttttgtagacaggaggtattaccatgttgtccaggctggtctccaactcctgggctcaggcagtctgcccacctcggcttcccaaagtgcttcagccactatgcctggcctctttttttcctataatggctagtacagtgcttggcgtgtaataagcgctaatgaaatatttcttgagtacttgaataagtgaataaatgcaagtgctagagaactaataataaaaggtaattttgtttgggaagtaacttgttgagatctgtggatttggagtgcaggtttgagtgacttgaatttgtattaaagacacttattttttctttgtagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctggttagtaaaattgtttaggactgtttggtttttattcagattattcaggaggaaaccgtttagttatggctagttcatttttcagttcagcactcatgttgataggcactttgttgaatataaaggatgggacaagagaatttaagctcttaggatgttaatagtcttgtgctgtagttaaaatttaggttattacctctttaaaaaaactttatttaggtttaatttacataccatacagttcattcattttaagtttacagttcaaagatgtttggtaaatttacagaattttgcagctgttattacagtccaattttagaacatttccatcacccccagcagatctgatgtgcccatttgcagtgacttttcccatccctgccccggaaaaccaataatctgctttctggctctgtatatttgccttttctggatatttcctataaatgaaattgtacagtaagtggtcttttgtgtgttgtttttttcacttggc

SEQ ID NO: 16158 - DNA, 1111 bp, Homo sapiens
ctacttagttatttcttcatgccagttatcattcattcagttgataaacattatttgtcattcttctcaagactaagaactgctatatagagaggaataatatgaagagctggccatcaccagaggctctttataagttcaattaagatcacaatatcagtcagacaccgtggctcacccctgtaatcccagcactttgggaggctgaggtgggtggatcacttgagcccaggagttcaagaccagcctggccaacatggtgaaaccctctctctgctaaaaatacaaaattagccaggcgtggtggtgcgcgcctgtaatcccagctactcgggaggctgaggcaggagaatcacttgaacccgggaggtggaggttgcagcgagccgagatcatgccattgcactccagcctgggcaacaagagtgaaactccgtctcaaaaaaaaaaaaaaaagaagaaagaaaagaaaatgtttctcttcttttcccaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgctctcattgcccaggctggagtgcggtggtgctatttcagctcaccacaacctctgcctcctgggttcaagtgattctcctgcc

SEQ ID NO: 16159 - DNA, 1155 bp, Homo sapiens
agtactttgggaggccgaagcgagtggatcatgaggtcaggagattgagaccatcctggctaacacggtgaaaccccagccctactaaaaaatacaaaaattgaccaggtgtggtggcgggcgcctgtattcccagctatttggaaggctgaggcaggagaatggcgtgaaccctggaggcggagcttgcagtgagctgagatcacaccactgcactccagcctgggcaaaaatgcaagactctgtctcaaaaaaaaaaatttttttgtagagatgaggtcttgctatgttgcccacgctgatcttgaactcctggactcaagcaacccttctgccttgtcctcccaaaatatgggaattataggcataaaccactgcatctggccttttttttttttaatggagctgactgaaatacttttgcaaaagaggtaggaaaattattcaggaaccagcattttgtaatacttagaaatcttggtgtgtactatagcttatggtgatcttatggggaaggaattacctatagttgacccagaaattctatattgcaaaggaaactttctatctaatatcctggaaactgaaagtaaaaatctcactgcttcctcctctgaactagtgtctgtcctatcgccacgcgagccatactcctttttgtctagcattgcagatgaagtcattaagacctgagggaatggtgttctggaggcctgtggattttgtctttgaccttgattcagcttgattaagcctggcacctgcaggaacaggcctggagggtgcagggaaagaagaagataactcaattcagaatcaagcacgttccaatatgttaaagcattccactttgtaatcatgcttacatggttccattattcttgtaagttgaccacatttgcatgcccctgcatgtatcatggctggcgaaagcgtgccagcagcccctaagtgaaggcctgggtacagaggattccagtaagagcaaatccaaaagtaagagtctgagttctcaccgtctccagcgtagaacttcagtgtcatgtacttttgtggtattcttcccattttacgaaagcacaagcattgcgtttccctcccttggccagagtattcctctcttgctcttgcctctgttcatttcaccattatcct

SEQ ID NO: 16160 - DNA, 1645 bp, Homo sapiens
tcgtgccagtgcactccagcctgggcgacagagcaagactctgcctcaaaaaaaaaaaaaaaaaaagtgatattattattattattaaataatattaaacaattattgtttaattatttaaacttgatattatttaatctttaattatttaagcttttaaataataataacatttagaaattgttatgccaggcaccaaaccagacattctgtcttcttaaattttcaccatagccctatgaagcagttagttggaatgggagcatctgcagtgatttgcccatggccattccagccgtaagtgatgtagtcatggtgggaaagcaggactgctgtttctactacagtgtcttgttctttattcatttgttttctttgcaaagtcagatcctttatttgcttccttttttgccatttacagccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaacattcatttattgtgttgtgcattaaatgaaaactttattttttctagaccaggtcttgctctgtcatctgggctggagtgcagtggcacagtcatagctcacttcaaccttgaactcctgagcccaagccattctcctccctcagcctcctgagtagctgggactacactcaacataccaccacacccagctaatttgtaaaatattttgtagagacgggatcttgttatgttgcccaggctggtcttgaactcctggcctcaagtggccctgccaaattcttgagattatagatgtgtgccatcacacctggcctgctatcttgaaacgacataaaatctttcaaagcagggcaatgggacatggctatagtcccagctactcaggaggctgaggtggaggatggcttgaacccaagagcttgagggcagcctgggcaacatagcaagatgtcatctctaaaaaataaaaaataggctgggcatggtggctcatgcctgtaatcccattgctttgggaggctgagaaaag

SEQ ID NO: 16161 - DNA, 1112 bp, Homo sapiens
ggagggagaaaaaaaagaaagaaagaaatttaatggtaggtaccaaggatggggataccattgaccagagaaaaggaagggagggagggaggggaaaaaaaaaaaaagaaatttaatggtgggtccccaaggatggggataccattgaccagagaaggggtaaagaagaaaaaatgatggacaaaatatgtttaaatgttggcactatttggactgacacttttaaccattatttactctttgttaactgtttggagttagtaaaacaaatacattctcttttgttaattcatacatagatattctgcctccatggtggcctctctccatccatagacacactggatcatataagagccctggatcgtttacaggaagttccacatgaggtaaacttaatttaaaaaagaagaagaaaggaaaagaaaatataaccacattttgaggatgataaagtatgactgataataatttgtaacatgtacttatttttcttggccagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggaggtatgtactttcctgacagaatgatctttatttcagattagtatatacttctgtaataaggcattatgacttaactaagaaacattcctcaccatttattacctaggtgaaaagaggaaaaacttgctggttttagcaagtagggaaagcactagtagaccagagcagaattataactcatttttgaaattgagacttagaaaaaagttacaaaaatagtaccccataattccctgtatgcttcattcagattcctgactgtaaatattttactatatttgctttatcattttgtgtctctcttcctcttcacccctcacactttcttctgaaccatttgaatatctgttgcagacagatactcctttactaccaactttctatgtgtattttgtaaaattaaggacacactgtcacataaccaccgtatagttatcacagttgggaa

SEQ ID NO: 16162 - DNA, 1174 bp, Homo sapiens
agctatctagtataaaatgctatgcattatttttcccttatcaatttatcctttaaatatgattatctacatactgtcatagtgctcaaaatatatttcattgatgcagatttagagaaatacaatgatactattttaaacaataattctgtcttcctcattccaaatctgccttgatgtcctagggtgaaaataactattctgtttcatttcatgtgccattgtgttcaagtggtaatgactacctgagtcctaggttggagatgattgtgaagctccattcaggcccatggtaaaagactgcgatgatttctgtatgttgatggggcagttagatgaggaaagcaaggagtagctatatacatgtcacatgttagcccttcctgccccaggcttttgtattcatcatcactaattttatttcactctcattgcatattcagtatattcacaaattctttttctcctcatatgtttggattgacaaaaatccatcagtgttctcagctatgatgactatctcaccaatgtcttagccaaccaaatgagatttactaacacctctgtgtcagtaaatccacagttgtaataattttcactgtagagacattgcaatgaagacaattaatagataaattcagttaatcatgagtaccaaaaatttgtcctgaaagttttccataactggtcattaattatgaaatattttctaattcaattaaatataaaaagaatgtgtaattttaaattataataatttacatatacgttaaaatcattttccaagttcttttttctattatacctcattttaccctgatgaaactcctgatttagattagttcaatatcactgtccccacttaacagatgaagaaaaccaaagcccagcaggtgaaatggtttgctgtaatcacttagctgcctaataaaaataccagggttttaacaagcccactgctcattgaagccttttatattaataataacatagaaatttaaagaggtaaacttgaaatcaaaatttggcaaaattaagcatatatgtttatagctcatttaaagagtttttttgaaatgcattctaggtattttgttgctttcatcacatctttaggctcaattctgcactcagtaaactcttggttttggccctggcagaaggcctagcaact

SEQ ID NO: 16163 - DNA, 1803 bp, Homo sapiens
aaaaaaaaaaaaaaaaaaaattaaaattcagctggatgtggtggcggttgcctgtagtcccagctactcaggaagctgaggtgggaggattgttgactacagcagtttgaggctgcagtgagccatgactatgccactgcactcctgcttgggcaacagagcaagaccccgtctcaaaaaaaaaaaaaaaaaaaaattaaagaaagggacaatttctgaacacagacatagacaaatcaatgccctagtctgttctagattgaggggacaaggaagggagtttggagaaatctagtgttttccctcttcctttatcttttctctccccgtaataggatatggataaactggatgccagcagtgatgaagatcaggatggtaaatcctccagtgaggaggaggaagaaaaggcccttagtgcgaaacacaaaggcaaaatgcccttgagaggaccactgcagagaaaacgagcctatgtggaaatagaatacgagcaggagacagagcccgtggccaaagccaaaaccacgtgatttccctttcagcatttatacccaggactgaacatgcagaactgttttttttttttttttatcttaaacacatacacacctccagtttttgctcttttgtgttgtactgaacacaatatttgtgtttttattatttatgccacgtcagtggggcaagaaatctggagtgagtgaagaaagctaagttgtgaacaagagtgtttttatagcatatgtgttgaagtaacagcttgtgcccgagaaacttaacagatgagttcttgaatctgggatgagatgacggatgtaaatatttctaaattttaaatgctacattacttggtgtccttttttctcccaaactttatttagaaatggaaggagttcaattttttcttgttctactttccctattcttatggaggtaaaaggaaaggaaggaaggaaaaagcagctttcacttacaaagtttcgtgtaaaaatatctttttttcttaaataactccattcatacaaattgggatgggaagaaaatcctttcctcttgggaaagtaatacaagtcttaagttccattgtagggtgcgccttcagaaacctgctgcacttttctgatatagttcaccacttttctgtcttcacagctttggggaattttggccaggagaccctgaaacatgaaaccaaacaggctttgatatttttttttttttaattactttccccttttgcttgattcttcttccttggtatcatattcaaaggaggaaagaatggatgacacttagggacaggtcactaagcagaataggtattagttggttttttattatttttaaatttatatagctctcatgtattgaaggtgctactttaaaaactgtgttaatgtacttgcaaatctcctgctggctcatgaaacagcagaattccagccaaggcaaattcagttggatctagggcttgaaaactgcccaagattaaagagctaagatgaaatagtttgaataaactggtaaaataacaattcatactatctctacatatttttaggatatgaatttttttttcctgctgggtagattgtccagtgacttatggcatgaatttcttttcatgctaccttcaatcttcaactaaagatttctaaaaggggtaagaaatgaggcagtagtttattaaatacatagaagtacacagctattatatgctgtggctttgagaagttaacttttgtggaatatgaaaccaaaggaagaatttccatgtagataaattaagaatagggaaaa

SEQ ID NO: 16164 - DNA, 1077 bp, Homo sapiens
cttgatctcctgacctcgtgatccgcccgcctcggcctcccaaagtgctgggatttacaggtgtgagccacagtgccaggctttttttttttttttaaattgagatggagtctcgcactgtcacccaggctggagtgcagtgacgtgacctcagctcactgcaacctccgccacccgggttcaaatgattcttgtgcctcagcctcctgagtagtagggactacagatgcacaacatcatgcccggctaatttttttgtatttttagtagagatggggttttggcatgtcagccaggctggtctcgaactcctgacctcaggtgatctgcctccctcagcctcccaaagtgctgggattacaggcgtgagccaccatgcccagcccaaagtaatatacaattgactcagatgaataaaaaacactgtcttatctgtggagactcaggaatgtggaggcctgcttggtgctgagatatttttaacttggcaacgcttttagttatcatcctcactttccaaggcaggaaaatgtctctcaattactactactcacacaatgcaaccttctactcaaattcagagaatccagacccagttatgaagaaatcatactattacctgaatgaggtggtgctctggtgtgtacaggtggttggaaatggcatggtataggacctgggctctgttatactggagcaaatcagcagctggctgcaaccagacaaatcgtcaaattaaaagaatagtttcccaagattggcacatgttgactatctttgaaattggattatgggtatgaagcatgaagaacatgccatcccaaaatatgcatgattgtttcgagttgaaaatattgcagaaactgtagattcagaaagggtgagctgacttgtctctttctgcatgcagcaagtgataaaagattcctctgggtggggtatgctttccataccagggtaagaaaacagcccttacagagacttggaattgaaggctgcaatggacctacataaactgaacaaagtaacctttatcttccacctatccatccccccaccacctacaaccatgtatct

SEQ ID NO: 16165 - DNA, 4015 bp, Homo sapiens
tctaatatggttcaacataagtcttccatactttttttttttttaacagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgttttttttttttcttctcaaaaattctgttcattggttccactcagcatcaagaagacagggacaaacaactcaagtgtcttaacagctgctggagtgggatccttgttatctcttagccactgcaggacctgcctgacaggttatgtgtgcacctcgagatgaagtgtctttctattattgtagagattctgtagtgaagaggtctgacaccatgtgtggaggaggaggaacgatcagtcaagagatgtcctggtcttaatgcctgtggcttgtgctgggagtgggtctgacttagtgataaaaggactctattcactaagtagcctgtgtttttaaatccagggctgcaggcagcaacgcaagtcaggctgaacattcagtctccagagacagctgtgtggagcaaatcagagttcatgcccaagtccccaggttggaatggctgtgccaaaatccattcaaagggttttctttttcattactaggtcagaacattttgagtcaccttgggagattcaggatggggagagcaaatttgaacaaaaggtttttcttatatcctgagattgaggggtagggggtgtccaacctgtatagcccatgggttgtgtctagaattaagtggagggcagctatctggagttaacttgcaagcatattggtgccctccatgaccacctctggcttaggacttggccctgttatgagctgacccccaccccccaccccccaccccccccccccgccaactcctatacccatcttccctaggtgaatctgtgaatggtcctttctggcagcaatccctgccttctttttgggcccatgcccagacttctggtttaaggaatggtcccagagcttgggccagcttgctcagaagttttgggagcattgagcctgcctagaaagatacagtgttagctccccttacttcaaagttgcccttctctgttctgactcctgggacttctggtcctgggcacactttttgcaggcaacaaaatgtgcctgggagtgatggattttaatgtgctccagagtcctttcagaaggtggtcatttcccttggccgggcgcggtggctcacacctgtaatcccagcactttgggaggccaaggcaggcggatcacctgaggttaggagttcgagaccaccctggccaacatgcgaaaccccatctctacgaaaaatagaaatattagccgggcatggtgtcaggcacctgtaatcccagctacttgggaggctgaggcaggagaattgcttgaactcgggaggcagaggttgcagtgagccaagatcatgccatcccactctagcttgggcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataaccaatcattttgtgtttgtatttccattcctttttatttctgcctttgtgtagactgatgattaagtaggcaaactacttctactttcaaagagccccaagggcttaatgaccccatttgtaactgagaaatgattcttgttttagtaatcattctataaatgatactgctggattgattgccgtgggttgatagctggaggaattgttttggacaatactaacatgtgaatttatgtcttagttttatttgcagtcttgctaagtaaaatgagtctttgtatctacttttttattaaagtgaaatttagcaatagttaatattaggtgacataaataaaacatcccagactagtgagttaagtacaagatctctctaaaaataaacagatgaaaatctatccccattatcgatacagaatttgtgaacgtggcataattcttggtaggtgctatagagatttatcattttaaacagttcacacaccactgcaa

SEQ ID NO: 16166 - DNA, 1707 bp, Homo sapiens
caagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttat

SEQ ID NO: 16167 - DNA, 1257 bp, Homo sapiens
cagctgttgtctccagacagggcagctccctgaacctctttgaagatgtgcagatcacagaaccagaagctgagccagagtccaagtctgaaccgagacctccaatttcctctccgagggctccccagaccagagctgtcaagccccggtgagttttggctcttctcgtgcagggcatttctgccttgccattggtggttttcaggcttacgttagaccagctcttgtgggtcccatgatatcatagtacccatatatgccaaaggtttgctggtctaaattatttttttaaccagtccctactgccagcctggcctgccctgtataaattgcagtgatgtttcccagctcagagctactgcccagcaggcatggtctgtcctttcagtcagcttatcagatctcagtggaacgcagtggtttgtagcagattgtgggtgttgcaagttgggaatactgagtttgggttgtagtgtatgcagaacctgtgttttcgaagttcttatctcacatttccctttgagccagatgttatcctgcctccttgccttttggcattggtttctggtatgagagaccctcggtcctctctcaagtgacagtgacggttctttgtgtccactctgccccttgttgtaagagccggcataagccttggggactggccttggggacttctgcttttctgtgtgatcacattcatactgacaatatttctgcggtctggggagtgagatttttttttttagagattctgcttactttgacatgcacacacacacacacacacatatacacacacatacacactgttcctcttaaacttatctgtgcctgttgctttgtgttacatctttaaccactttaaaccttttaggtgcattttgtcctgtaataatcaaatgctcgggccttgtgttaatcaccacaagaaaccagaggctattgctttaccgggatcttttcatttctattgcaacagacttttgtgtgacggatctgcttggttataaaagtgtctgttgtgtatgttaagtgttagtgttcctttttttttttgagacagtctccctctatcgcccaggctggagtgcagtggcacgatctcaactcactgcaacctccacctcccaggttcaagcagttctcctgcctcagcctcccgagtagctgggactacaggtgcacaccaccacacccggctaatttttgcatttttcagtagagatgaggtttcaccatgttggctgggctggt

SEQ ID NO: 16168 - DNA, 1190 bp, Homo sapiens
gcagaccccttccattggatcattccatgtgaaggggagttggggccgtttggaggtagcagagttctgggtggcagccaggcccccaaataagcctcactactctggcttttttttttttttttttatgaaaaggagtctcgctctgttacccaggctggtgtacagtggtgcaatcggctcactgcaacctctgcctcccaggttcaagtgattctcctgccccagcctcctgagtagctgggattacaggctaccaccaccacgctggctaatttttgtatttttagtagagacggggtttcaccatgttagccaggctggtctcgaactcctgacctcaggtgatccacccatgttggtctcccaaagtgctgggattatgggcatgagccaccgcacccagcctcctctgggtttttcaggagaatctgctgcctctactgcagccacgcctttaaaaagtggaaaaaccggcaggcaagaggctgcagatggcttgaccaacctccctgttcccttctaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgagtgtcggggcttggccaggctctaccttgggaaagggaatgtatgaggctcctggagtccatccactgggggcaattccagggaggaggaacaacagggactctgccctaccctctaaggagcagctcagagcccagagggtgagagtaggggtggggaggttgaactcttcattggtagcaactttccccctgaaaggggcccaggcacctcaggaaaggtgatctggcacctttgggtcatgtaattagcggggagtttgtttgaaatggcagcggctgcacacagcaactttcgtaagcatgtgcctctgtataattgtctctgaagcatttccacttggaacacacccatgatgtttgtggtgcaagagacaagttatcaaagacacagtgtacttgtcctttgggaaattatatgtctacaagataagaaatacatccgggatgcctcctgttgggctgttggtcccctagtgga

SEQ ID NO: 16169 - DNA, 1491 bp, Homo sapiens
gaagccaagctgaggccggcgtcatgcttgtacagcctgcagaaccgcgagccagttaaacctcttttcttggctgggcacggtggctcgcacctgtaatcccagcactttgggaggctgaggagggtggatcatctgagatcaggagttcgagaccagcctggccaacatggcaaaaccccgggtctactaaaaatacaaaaattagctgggtgtggtggtgggtgcctataatcccagctactcttttgggaggcttaggtaggagaatcgcttgaacccaggaggcggaggttgcagtgagccgaaattgggccactgcactccagcctcggagacagagtgagactccatctcaaaaaaaaaaaacaaaaaaacaaaaaaaaacttattttctttataaattacccaacctcaggtatttctttatagcaatgaaagaatggcctcatataccaagcattcacccattgttgacctggccctctgtcccctctctccccaggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggccaagagttgggccccgtctgagcttttttcaactctgtttggtaactaacaccagctgctatctgtacagtgctgctgctttttttttttttttttttttgagacggagtttcactcttgtggcccaggctggagtgcaatggcgcaatctcagctgattgcaacctccacctcctgggttcaagcaattctcctgcctcagcctcccgagtagctgggattacaggtgcccgccaccatgcccagctagtatttttttgtatttttgtagagacagggtttcaccatgttggccaggctggtctcgaactcttgacctcaggtgatccacccgccttggcctcccaaagtgctgggattacaggtgtaagccaccgtgcccagccttgtacagtgcttctaaagcgtgggcctgtccttatttgattctgactctgatcctgtgggtaagtagaacaactgttatcctcactttacagctgagaagactggcacaagaacaggtaaaatcgtgcagctgctgaatggc

SEQ ID NO: 16170 - DNA, 1141 bp, Homo sapiens
tttttttttttttgttgcgacggagccttgctctgtcgcccaggctggaatgcagtggcgcgatctcggctcactgcaacctcctccccccgggttccagcgattctcctgcctcagcctcccgagtatctgggattacaggcatctgccaacacacctggcttcttttttttgtctttttagtagagacggggtttcaccatgttggccaggctggtctcgaactcctaacctcagttgattctcccgcctcagcctcccagagtgttgggattacaggcgtgagccaccgcgcccggccttgtttttacatttttaagcgaatcaaaaatacattcaggccaggcacggtggctcatgcctgtaatcccagcactttgggaggctgagacctcaggatcacttgagaccagcctgggcaacatagggagacccccgtctcttaaaaaaataaaataaagtaaaatacattcaagtcaactgatttgagtctcgaactgctctgacacaggaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcgtgagtacttttcatagtttttgtgagaattgctcggtaaaataaatctgaacatgctcaacagttactttgtgggcaaaataaatgcaaagtatttcctatgtctcctaacccctattcagcaagtaggatgttgaatcaggagttgttttaattcccttagcatgttatctgcttactgagggcacagctctggtagatacaatggtgggtattgcccctccttttgagttgacaacctggtttggagacaaaaaaaaatgcaattacaaagtgttatataaacaaatttagaacaatataaaccttgtgttggtgttttggatttttcagaaaggatatatgtggataaagcctgttgtccaaaatttgagatgacccatgctctttatgcctgaaccatcctttttttcctttctcattgctgctgactcactcctttaggtatattgtctactctcctcagcaaacctatttccaatca

SEQ ID NO: 16171 - DNA, 1196 bp, Homo sapiens
ataagccaggtgcggtggctcatgcctgtaattccaacactttgggagaccaaggcgggcagatcacgaggtcaggagttcgagaccagcctgaccaacatggtgaaaccctgtctctactaaaaatacaaaaatgagctgggcgtggtggcacgcgcctgtaatcccagctactcgggaggctgaggcaggaaaattgcttgaacccgggaggtggaggttgcagtgagccgagattgcaccactgccctccagcctgggcgacagagcgggactccatctcaaaaaaaaaaagataatcacatgtaataaaaactaagtaacctaacaactttctcttttttgttgctttctcattccttgccagtatcttatgctgagatttttaaactcctcaactaatatttcaaacacctgacctgatatttgtgatttttaaattgttttattggactaatgtttttgtggcaattgtccccaagaacctcaaataagttgcaggccttcttttaatctctgtcaccgcagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggtaagctggggccttaatatggacatcacagcagatagagaggatagaccatctggccaagggctaaggcttcaaggctgttgggtttaccagattgtgggcatagaattcagttcctgagggttgagctggtttgctattcccgggatatttttgtaattctttgcttgtgagaaagtttttaagcaattttacaaaattgaccaaaaaacataaaaagaaataggatctttttccttcagcaaactagatttgacttgcaatcttctgacttcctgtgtatgtttttattgggacaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggtgagtt

SEQ ID NO: 16172 - DNA, 1727 bp, Homo sapiens
taaagtagctgcctgtggggatatttaacgttttatctgtaggtgtctgcttagcaacaaaaggaaaggcagtttcttgcatgactcagctttcagcttaattttttccttttgacagagcaaattgggatcctgaatttttatttttctttgacaacagaaatcaacacagatctcttttagttacctaattcttgatggacatcaggatgttgaccacttttagtaatatttaatatatatcttatttgttccatttatcccccgagtattgtagccacatttaaagtgaaaatttcctgtgtcaaattaacttttccaatattttttgtccattttttccatgtctgcttgaattgaattcgctccaggtttccattaactttggaccatgcttcaagtatcctccgaaggatctcacttaccgccctgtgagtaacattacaaatggctgcatgtgtcctcagcatctccgtggctgctgtagtcaccgtgttctgtttctcattcctcctgcagatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttatgtgacactttgcttcccttcagattgggtgcctcttggtgacagtgttcagaaatgtaagcagcacgaggaagggagctggcactgggaggaagagccgggtttctgagttgtgttttggctgctttcctattgctcccattcttgccaatcagccaccccctttcctgtgaaaatctgccaccttgaggagaggaacaagagtttaaaagggctaatgatctccctcccggtcttcccttggaacatggatgttgatatatgtgcgggtggtttcctgtcttgcttatcttcctttgccctgagctgatggctaaagggcagttttcggactattaaagactgaaatgtaagaatgagccttctaggctgggcgcggtggctcacgcctgtaatcccaacactttgggaggccgaggcaggtggatcacgaggtcaggggttcgagaccagcctgaccaacatggt

SEQ ID NO: 16173 - DNA, 1176 bp, Homo sapiens
ttatttattataaaacaggagctgggcacagtggtgcctacccacaatgccagctactctgaaggctgaggtgggagaattgctggagggcaattcgaaaccagtctgggcaagatagtgagacctcatctcaaaaaaaaaaaaagaaggaaaaaacaaaggagttgatgaaaccaaattatgacaaactaaattaaaaaattaaaaaatagcattagtgggaacactgtggtatttcctgaggtattaaaattttacaactagtaaaggtatttattataatttattcggattgtttcttagtttatttttgacatggataaaattattgtttatctaggagcctcagagttgagagaggatagttgtagagaagtatttctaaaatggaattatcatccactaccagctaagagaaaatagttacttgtttaaagataccttaaagcaacatatattgtagtttcaagagaacaggctgacagtcaagaaataggcttttaacaaacccactggtttgctggattctaattgcctccttcaaactatgtaattgtgtctttctggtttctgtggagatattttcccacttgtttaattttacactggaataaaacaagttatcactgttgatctgattacagaaactattttatataggacgctgtgaagagtagatattctctgagcccttcaaatgaactgtattaaaacacacacacacttttgaagtttgagaagaacatcattacctgtaacctttgatttgtgaaaatatatacaaaaagctaattttataatttagatggagagtgtgtatacaacttatatgtggtaatttatattacaaagagttaacattcagcttcctctaaataacaccaccctcattttcttggagtacctcaaactccgatgatctagaagctttataaccaggtctgcccttgaagactagttcacgcattaataggtgtctagggctgagcctcagcctccaatcacactcgacctgtataggctttcctgttcagagatatgcagtggccaaatcaaagtgtctgggtgattcatcgggagacaaatatattaatcaatgctactatgttaaaataccaatattgtcttgaagtgtgggaactctcttaaacaggaaaatgataagatattcagaag

SEQ ID NO: 16174 - DNA, 1229 bp, Homo sapiens
gtgattttataagataatatggtgataattttattctaggattttatttttggcctaatataggaatgtttaaaaaaggcttttctatgaaaattagaaatttatacttgaaattaaaagtctagaagggggaggaccttaaagctaagctaccagtaagacaatgaataattcagaagagaacactattcttttactgactgagtgcccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgttaacatcttacgtaacaatagaacatttgtcaaaattaagaaattaaccttgatataatactaactaaagtagaaagtttaaaaagtagagattttagtcttttcactaatgtccttttactgttccaagacccagccttgcatttagctatcatgcctacgtcctgtcttccagtctgtgacagtgtatcataacaggggatacctgatgttgtaatgtatttctggtgttgttaaccttgatcactatgctaaggtggtgtctgctaggattcgctactgtaaacttactgtgttttccttgtaattattgaatatttgctggagatacccggagactatgcaaatgtcccgtttctgcttaaacttttgctcattttactatccattggcagatcttgcttgtggcagttactactgtggtgttctaatggtgattttctatttctctcaatccttctacatttattattggaattcttctgtaaggaagagttgtcagttctggatttatatttttaactataataagatattcaggataagtatagatttagaacttaaagatgttaaatcatgttaaaattattccaaataccaatatcaaagaaaactaagttggtaatctatctcagaaaatatatgaacttaagaaggaaaatagtatttatgatttgtagaattggttcaacttttgacttaatactgactttggactgaattcaaagttttcttgaaatttcacatctggactttttaaagtgtctacatttatattactttggggatcattttgtcaaagtcttgaataaagttacccagtcctggcatgataaacacaactatg

SEQ ID NO: 16175 - DNA, 1204 bp, Homo sapiens
aaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccatattgactagtggcctacttttacctggactcacccgtctcaaagtcaagaaaatcagtacagtcacgattttctctgtctttatgtattactaaaacaaaaaaataggttttgggcaaagaactaatatgtaagttctttcctgttgactggtattttaattgtcataggcagaatttaagttcagaatttaaagcatggcaattataagagactttcctttggtatttataaatattagccagtactatagataacagcagttgaatcacttagggcggatggggaattcaatgttttgctttactaaagttccagccccttaatgtactttaaatatttaaaaaagcacacatttaccattttatttgaatatcaggtttactgaaggaaaaagatacattgaaaatataggaacatacacataaaagacaatgtcatatttaaagtataatcacaata

SEQ ID NO: 16176 - DNA, 1192 bp, Homo sapiens
gagccgggcatggtggcacatacctgtagtcccagtttctcaggaggcagaggttgcagtgagccaagatcacatcactgcactccagcctgggtgacagagcgagactccatctcaaaaaaaaaaggtaaccatagttctgaagtctttggccatgaatgttctttaatggtctaaaaagcggttttagtcatgctggtgccaaggagttctcctcacacctccatagcgtcaatgttgacctatttgatatatttttaagttgcagattatagatgcagaaagagaaaattgtcctttatgtgtgcatgagtatacatgcactgtgcctgtgatacaccaatgaaatattccaaaagacattgctcactcatagtctgaagttggtatttgttaacttttaaatctatatgtggtcagagtgtaagtggctggtttttattcttgtccaacaatgaaataacttaaagcagcatgggctaatggtggtattttttttaaccacatgttaatttgttgaaggaagaagtgaacataagatttttgataatcagcctaaagcttcagaaactggatcagtaagagctaaagatgaaatcctgggaaactttctcaggcactgtgcaggggagggaggggctggaccgccactgctgcgagggaagaatcagaagagctgcctgtggctggctgagaagggcaaggtggatggctcttcattcctggaaggctgaagcagccagaggcagtgattcacctctttaatgtctaatcagggagagatacaggagtgaggtgggttttattttcatttttgttttaacaagttcccactcttatcttaattctcaaaaatgatctggcctcatctatagaactggctgagttggggaatcatttaaaatttgggattttctgtacaagtcaagaacatatgtgaaagctaaaaaagtaatggaggcagggggactgctcccagctcccttctgccatttacacaaaatatttgaaaacatgtctgtaaataacgttgtggaactgagatattgagtatctaatcatgtaaaggaccctcagatgggacaggctattggacaactttcctggttcatgaagtggaatttcctttttgagtagtttcttgcatggtgtattccaataggtcaaacccagacctactgtttgcaaacag

SEQ ID NO: 16177 - DNA, 1183 bp, Homo sapiens
taaagaccctctttgacttgtgcaaacttttgctaattatcacagtcttctgtaaaacagagcttctgttggaagcatcaaatgggagccatagttattgtgctgtgaaaattaggtctttgataagtcctctcatacctagtagcaacatgtcttatgtgaaatcctgttcttgttctaccaggttatcccgccaccaaatgagaatataggtgtttactccctttatttcagagaacccacaaacaagcgtattttctcttgttttcagttatgaaatttccatctagtgaaagtagaaatacccaggataaataagtgaaaattcacatgaggctttgatatttttgtcaactaaatgacaaaagagatggttattaatctcagcttattcatcaggaaagacaacctttctcggagtagcaccacgaggcagtagcgtggatgttttagatgttcctgttcacattgccagatgacttacctgctgcctctctctcgcttgcgattttgttttctaggctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaaggtagcatgggatggtggtggggggtggaagagaccagaacctggcttttcaggaatgcttcagtagggtatagttctagggataaaatcagcaggaatttgtggtaaaatgttaaaactttccatgttgagagtttggtacttcttgagcaaagaagagtagtaggaagaagatagtgataaaatgtgcttaaactttgagtgtccagtggctagtcataaaaaggagagaggggacactggtaatttctatgtgaaatggtttttacttgttttttttattgttttatttttattttcttttaaagacagggtccccattctgttacccatgctggaatacagtggcgtgttcatagctcactcaagccttgaactcctgggctcaagaga

SEQ ID NO: 16178 - DNA, 1224 bp, Homo sapiens
actagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatc

SEQ ID NO: 16179 - DNA, 1183 bp, Homo sapiens
aataaattagccaagtatggtggcgtgtgcctgtagtcccagctagtctgaaggctgaggcaggaggattgcctgagcttaggtcgaggctgcagtgagctatgtttatgccactgcaccccagcctgggttgacagaatggtaccccatctcttaaaaaagagagagaaggggttaggcattcccttgcatactcgcatctgctggctgtgtatgcacatgtgcgtgtgtgtatgcgtgtgcatgtgtgtgtctgcagcccccgccatccctcctgtgttcaccttctggctatctttacctgaaaccaaacagcccctgcccgccggccccatttctccatgccgctcaccgcccgcatgctcggatgggccagtggctgccagcatctggtgaagggtcgtaaccagccatcgtcttctcaggtctgccggagttcttccctcagggtctcaccctcttcctctaacaggttttgctgcctggtggttttcgtttgttccttgttgcaaagaagatgtcagggagcatttcttcctctagtcccccttctttctgtctccttcccttgctctgcgtctcttagaggtctcatgtcctgtgcttgtccattttgcttccgttgtctcttctagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaaggtacacactgtaacttctcctctcgatgtcctgccctcgccacgggcacggggggagcatgcatttccaggcttggggagacacagaggcaggagagctggaagaatgggctcctgcctgcctggtgccacatcctgccccagctttgagggctgaatcctctcagctcagagaagagcttccctagttttgcaggcgcacggaggcctcccacccgtacacctgcctctgctctccccctggccattgcaatgcatgcccgggatctgggtttaccctgcagcccgactcctccagggcaggctccttccgtccttgggtccagcagcctcccccctccgctgggtactgagcatctgaaaagtctcagatagggccctacacctcttctcccttctcaagt

SEQ ID NO: 16180 - DNA, 2442 bp, Homo sapiens
atccctgtttctcactaagcaatttttagctttccgtttttatatgtctccggtgtattttctttactgcatttccaattatgtactcatacctgtgccatccattcatcaagagcaggagtttttatcacagggtctgttagcccctagaacggtgctccctgggagattcagactccagcatccctagatatgctaatggattgagtgagacccagatacttatgtttttgacaagtaccccagataattcctctgataacaagaaaattggggaactaagagattcatggacaagtttcagagggctggtgactgtcctcaccctttactcaatttaagcatgattttatgagtacattttttgaggtgtgtagcctttttttctttaaagcatctctgatgtagaaaagttaaaaatcactgaattaggatgtctagggtagggtagatccagacttgggactagttaactctatttgcctttatttcagaatacaaagtggcctgcataattatgtcatttgtctttcagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtca

SEQ ID NO: 16181 - DNA, 1699 bp, Homo sapiens
caactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagag

SEQ ID NO: 16182 - DNA, 1348 bp, Homo sapiens
ccagagattcctcagataaaagagcctagaaaattgagttttgagcgggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgcagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcg

SEQ ID NO: 16183 - DNA, 1311 bp, Homo sapiens
tgcagtgattctcaaattaactgtattggtgtaagagttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaaaaagttataattttagataaaaattctagtcaaatttttacagatattatctcactaattttcagacttttgccaaagtgtgcacaatggctttttgttaataaagaacagattagttttgaagaaggcaaaaatttcagttttctgaagacagcatgttattttaacaatcaagtatacatattaaaaattgtgagcaatctcaaatgaaggtccatcgtttcattttaaatctctaaatgaattcatat

SEQ ID NO: 16184 - DNA, 3490 bp, Homo sapiens
cagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaatgatactgtgagctgtgacttttttttcccactcagtcatacacttctcaccctttccggtgaaccacatgtatctttctcctcttgagtttcttcagtgatgctttctggtcccagttcaacagcttgcaaatggtaactgggtgtgggtgggctgaaggagaacttgggaggcaccacaggctacccgtggcccccaccctcccatttaccatctgctcctataaataacttccagaagtgtttctcctggttgtgtgtgtttcagatcagagagaaggttaaatgcttgctctacaagaatgtagctttcggccctgcctgaatttcttttccatgtttctcatggaaacattctctttcccctccggctcaactcaatgtta

SEQ ID NO: 16185 - DNA, 2231 bp, Homo sapiens
atacatgattattccatcacaactagtgataataaaaacagctaatgtttgttggcacatctgtgccagcactattctaaatgcttaattttaatcatcacaacaaccctatgaggtagatattgttatccctgtttttcagatgaggaagccgaggcagagagaacttaagttgctggcccaaggacaaacagctagtagacagcagtcaaggcagcgtggctccatggtgatgtgcttggtcagagatctgaatatataggacttagatttgtagactattgagctgtagactcatttagacaaatggtaccaagatattttagtagataaaattctaggttagtagaacatagaccacatgttataagctgatatcagttgatggaagaaaaatggttttacaagttattttcaggatctctatcaaacctttacttctccctctaattacagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattatgcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagatatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaagttgtctctgtgtcatatttggtgggatttggtagtaaatgatggtaaagtggtaaatgataggacactaaatttgtcagataatactagaattgtagtagtgtaccgtacaatgtagcttagtgttttaaaataaacatcttacatttctatgtcacacctctcaatttcttacctgctttatcttacaacagcaggtatattataagtaaaaattaaggagtagtcgttgacaaagcctgctctcttccccggacagcatgagcttcaccactccctccaccttctccaccaactaccagtccctgggctctgtccagccgcccagctatggcacctggccggtcagcagcgcagccagcatctatgcaggcactg

SEQ ID NO: 16186 - DNA, 1201 bp, Homo sapiens
gtaatcccagctactcaggaggccggggcaggagaatcgcttgaacctgggagcaggaggttgcagtgagccgaggtcgtgccattgcactccagcctgggtgacagtgagactttgtctcaaaaaaaaaaacaaaaaacaaaaaaaaaacaaactaggcataaactcatgaggtcaggagatcaagaccatcctggctactaaaccccatctctactaaacccatctctactaaaaatacaaaaaattagccaggcatggtggcgggcccatctactcaggaggctgaggcaggagaatggtgtgaacccgggaggtggagcttgcagtgagccaagatcgtgccattgcactctagcctgggcgacagagcgagactccatttccaaaaaaaacacactaggcgtaaacaagaatgaagacctggaaccgtagagaaaatactagaaacccctcgtatcacgttgtgcctgaggacaataataaagtagtttactaggcatcagacattcctcagcagtgctgtgggtcacgggcgtgaagcggagctcgaggcaggattgcttgtgttgctgcatgtcctgtctgctgttttagcccgtgtcagtagatggggccattgtactgtttgttctgcacacttggcggagcagcagaggctctcagcacgccttttccctttgtagtattttctgagctaaggaaagtcaggcagaagtagttcataagaaggcatcactgcctgtgatcggggctgcatttagccctgacctgataatggtaggagagttcatttagcctttctgctgcgaagattgtaaatagattaaagaaaacagctgtggccttctcccgtcatacatcattagactgtgtaaactaacattttagaacctctaatattggacttaaaaccaatttctgtcgtgcttaattgaaaatcacaactaaaccaataaaccattattaaatttccattctgcagcagaaggcacctctggacggctcccggcttgtagtttaatgaagtatgtgctccctgctgttaacccgcagccctccccaactctccagcagctttgccaagtcagcctccgggccatctggctgtccttggccaaggcactgttaacggagtgacgttaaccatcttgtattgtgacctgtggccgcttttctggtttaagtccttcactttttc

SEQ ID NO: 16187 - DNA, 1643 bp, Homo sapiens
tatatacatgtattttatattcagaaagtttgaccaccgatcatatcatttgggttgaaaactgtgaaacctctatgtttccctcccacattcatgtctgccacctgttgggtctgcctggtctctttgaccttgatgacttgagaagcagtcattgaccacactgacagttttaggcttaccctaaaacagtccgcctggcccccagcatattgacatttttcctcttgatttgtgtgactgacaatgtttctgtttccctcccccagctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcggtaagttatgctgttacaaaaggttgcttcacagaggagggtagaagtgcatttagcaaaaagttattcttacaggcctattatctctttattagatagggagaaagttgggagaatgggaagtggctttttgagtaagaagaataactaaacgtctacttttgaaaggtacttgtgtgtttgatttatgccgagccgagggacctataccatgactccacatgttgcctgtttatttcaaagagaatggggcttagaattaaagaaaagcactgccaatctctgtctcttcttgcataactgatgccatagctcgaagctgctgcaggcatattccctcactgagaagcatgggagagcc

SEQ ID NO: 16188 - DNA, 1622 bp, Homo sapiens
tcctttgtgaggtgaagatgaatgttagagtagaaagaattgtaaactccttggtaggtttaagcagttatcaagtaccttgaatgtgagtagtaaattctcacccaagggcaagggtagaccttttgagatagaaagggtggatattgggatcccggagccccaaatcccctgaggttgtcttggtgagagtgccacggggtaccctgtttctggcaggtttttcttggtgtttgggcagcatggtgcatctcccatggtgtgagcgtggctgggagccctcttggctgttactacatccagcctttgtctctccagggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatgaactgggggacttctccctttactttctcccctggctgtggccctgagtagcaggcttctcgtgaggattcccgttctcttctgggagcatggccctggggctgcggagaagccaactgactgctggagcgaggaaccctgcagctcagaaggtgaacagctcgtctcagatgcttgcagatctttggttaatttagaatttccagcacagacgtggatttctccagagacggggtgtgtgcgggtcgctgatgtgaggcctaggggaagcaatgagtaaactc

SEQ ID NO: 16189 - DNA, 2609 bp, Homo sapiens
aaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttggatgtctgtcttgcatgtggaatttttctcccttcccagtatgtcagaactcttcaattcttgttctacacccagagacctataaacattagtcttttcattttcctctttattataggagtacaagtccatggcctttgctttgaaattccagttttcatttatgtctgtgtttaaatgccaacaatatggatgggttttccatttccaaggaacatggcacggtaaccctactttggattttgtaggggcattcatataaaaacctcctaaagggattttaattcccgtcccccccactcccctaaaaaaaa

SEQ ID NO: 16190 - DNA, 1129 bp, Homo sapiens
ggtgcaagaaggatgaccaaagagagttaaacgggttgctgagccctgctgaggctcggggagacagtgtaaatgcttattgacagtaatcgggctaatcctatgtttctttccagcatttgattaaactcagcattgtctgtgtgtgtattggcaccaaggaaataaacagctagatcttggaagtctagttcatgcttatttttgttggcagtgcactgaaattctgatgatggtgctatttctccatgaggcttattcatttagcatcatgcacctgccttggtaccagaactatagggcaaacaaaaagacacagactctgccttcatgaagcttttagtttcacaaacagacagataataaacactcataaaaataaaactgtacttacaaactgatagtcggaaggaaatgagaatgcagtgaggggttctgacgggctgggctaccttgctgagggttggggttggagtgtttatgagaagggaagacttttgaagaagtaacaatttatacatagttccaaaagagtattcaaaagtcagcagagtaaagagctagagaagaacatttcagagacaagtggattgcctatgtaaacgtctaagggtgtgaaagaggttgataaacttaaggaactgaagttcagtgtaactcaaatacagtgaacagaagagttgcataaggtgaagctggggaaatagactgaggccagaagttagaattggggtttttatcataattgcagtgggaagacattgaatggtttttagcaaggaaacagcaagatctgtttcattaaaaaatggtttttcttggctactacataaagagtggtttagaattaagcaagagtggaagctgggaaaccactttgcaggcttttccggtgatcaggatgagagaagatgttagctaggactagaggggtggtggtagaaatgggagagaagtggatggatttagatatattttggagttggaatcagcagaacttagtgatgagttttatgtgtagcttgaggaagcaagagatgatcaaagatgacttccaggttctctgacttaatttaataaagaaagtggtttgaagccacttgggaaagttcatgttgactagataaga

SEQ ID NO: 16191 - DNA, 1976 bp, Homo sapiens
attggtagagtgtagcctttgtggctcacctgtttttactttgcaatgtctgctcccacaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaagtttgcctctgaagcctttttctcaatattgacaatttttctttcagagtgagtttccacaaaaaccaaagctatataatttggcccttgtatttttcacatacctttttttggtttcccttatttgactactgttacgggcttgtacagaaaacacaggtgagcaggaaagggaggcacggcgtccccgccccgcattcagaaacccgcagtcagcagctcatggagcagtcggttgccatgttcagggctgaggacccagcagggaagtgcaggtcttatcctttgctcaagcagccaaaaacaccctggcttgcatattctggagcccccagagggaaaccccttaatcctctgtagcggtggtggcacaagctccgactcccttaggagctgtgaaggtgacagatgaggcaaagtgg

SEQ ID NO: 16192 - DNA, 1163 bp, Homo sapiens
ggaaaagattcggaaattcatagcacatggtaacatagctaagatgcattgtgtaatagagtgttgtaaaatctcatggtaatgcagtgatgctgaagtcatctgactctcttagaggatgcttggaggttggaatctcaaattatttgttgaatgtagccagttagggccaaacctggacttggctgtagtgagcactatgggttttgaggaaggagatgctgagctctgggctttggtcctccggaaccggcttgacccaacagatcttttctgtttccaagtctgacatcagctcatgtgattccagggctttaatgtgtctgctggccacaacagtgggctctttgacattgcatttgtgtgggagagatggccccagccaatgccatttctgcagaagtggagcagatcacaggcagtgacaacgcccatccttttggccacactggggtttgggaagagtttcttgtaacagtattttgtatcattttgtctgtgttggctccaaatgctgctgggatcctgaccttccactctgtctccttgtcttcctacaggaagaccctgttcccaatggcctccgggcactcccagtattctatgctgctaccatagcaatcaatgtcttttccatcatgtacacaggagcaccaggtaaggatcccttggaagcatactccaggggcaaagtgcattgtattctaacagtatcagtttatttggtgctggtattgttggctgacagtaaaaagcattactcatggtcattatggaataggtgctggagttgttggctgatagtaaaatgcgttactcatggtcattatagaatagtaaaaagagtggtaaatgcatttacttgtcttaattaaatacccaagagatatgtagagtacaaaggcaacagactttcaagttagaaaaaaaaattaaatccccactctgccatttacgcagctgtgttgccactatagcttagcctctctgagcctcagaacctgatctaatcccacaggcctacagggttgtgcaggggtcaggagagggtgtggagcacctggggccatgcctggcacccagtgagcgggacagtccacacatcagcaatgcccagcggagctctaaagccgttcacagcacagagtacagacccctggaaa

SEQ ID NO: 16193 - DNA, 1242 bp, Homo sapiens
ttgcatgaaaaatgtaacctagtaaggattactattagtctgtaattattaagcatgcttcaactcctgacaattctagaaagcaggtttttttgtgtttttggttgggggtggttatcctaattataatcttccttgaattgctttatggttaggtccgtcacatgccaaagttagatcccattagcaggcttaaaacatttatttctgaaagaacaaactgttacaggttgctgagtataattgatttcttttgtttcctttctgctacaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggtgagtagcctcttctctataccgatgggacatccgcccactgacccgcttccctgcagtactttgcccatatccataaatgtgatttttgctttggcttttcaaaaactggttggatgtttcacatttactctcttatttttgctttctgcatattaatttatgatttttaaagtgtttaaatatcaggcaaccatttattttctgaacttttgagcaaacttggttgctaaaatagatttcagctaagtgaatacttttcagaaagtacagaaaaagacctttgtagaacagcgctttattattttagagttgtttgaaggttgtctaagtgaatgtgttttcaaggttgatgtatgaaatttccaggaaggttgatttagatttttttcttaaggtttttcatcaattaggag

SEQ ID NO: 16194 - DNA, 1140 bp, Homo sapiens
gaaatataaacaaaggaacatatttttaatttaatgaagcaaaattccatacatcattttgaaaatagtgtttctttccctgataggcctgttctgcatcattcttttagcttccttctgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccaggcacagtggctcacacctgtaataccagcactttgggaggctgagttgggtggatcacaaggtcaggagattgaaaccatcctggccaacatggtgaaaccccg

SEQ ID NO: 16195 - DNA, 1105 bp, Homo sapiens
ccaagtcatcaattcagtagttcatcttacagcggagtgtaaaccatgcttttcaattatttgcggttcttttactgtataccctgtgatgcccttttaagtttttttgaaaatattgtatacttaaaactgaagtgaaacattaaaatttcttattagaattatttttcagtcttagctgaaatacaatattgtatgaaaatttgcactgcattattagtttttttttttaatctagttgattttcaacttttcttttttaaaggcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagatctttggtatagttgcattctaccctaggttattttctaggatcaagaatagaacaatttctgttctttccagcattactctttactattcatatgttcttgttc

SEQ ID NO: 16196 - DNA, 1269 bp, Homo sapiens
ttagaggatcatgaagtgtaatacatcttttccaaagaaacaaaattgttttaattctagactaattacttagcggggtacagtggctcacatctgtaatcccagcactttaagaggccaaagcaagaggatcacttgaggccaggagttcaagaccagcctgggcaacatggcgagaccctatctctgcaaaaaataaaaaattagccgggtgtggtggtgtctgtctgtggtctcagctacctgggaagctgaggtgggaggattgcttgagcacaagaggttgaagctgcagtgagctgtgattgtgccactgcactgcagcctgggtatcagagggagactctatctctgaaacaaacagacaaaaactaattcttcattgagaatcatgacttgactgtaatgtaatattgttaagtagtaatcattttgcagttttattaattttatctcttctttttcttgttgtgaatagcaagaaagtacgactatcagcagccacaaaaccaagctgacagtgtgcaactctcattggaatgaaacctcagaaaaagagcaacagaagtaattgtttcaagctcctgattctttctactaaatcatgaacagctttaaaaacatttctgtctgcataaaattattttacttgtaacttttccccaattgttctgtgcattgttttgcctttttaaattacatctccaagtggctcaaaaggccttgacacagggaacctgcacatatccaggatatgtgtaaccagcgatggtgacttgaccttgccaagacctgtgattccttcaggatacaatcagtgagaaataaaaacacatcttgggaagtgggaatcctggagtttatgccatttgcaatattaaaaaataaaaatgcaagttattatttcaataataacttcctgtttcattgtattctgtgagtgataagtgtcagatcaataacagattaatttgttgttaacagctctttttttttttttttttttgagacagagtctgttgcccagactggagtgcagtggcacaatctctgctcactgcaacttccacctcccgggtttaaacgattctcctgccacagcctcctgaatattctgttaacagctctttaattaatgatctttgcttcttcagaacttgtatggtagaccgtcttttctacagcatgatgcatactcctgtgctaattttagaagctttctgtaactagatttttcctcattatgctcccaggagcgagtttgttttt

SEQ ID NO: 16197 - DNA, 1106 bp, Homo sapiens
tttattgtaaaatcagacaattaagcctgaatttttccaaaagaaaatttgtgcctaattatgggaactaaaatgcctctatgagattttaatctatagtgagtagtattaacattcctaattgtgctttatgatacactgtaacaaattctgcatgatgaaattttcttttgtgaagtatgttccactattttttcattgattcctttttttgttttaatgttgcagggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgtgcctgtgtgttaccatgctaagaatgtctttgtttaaagggaattaatctttttatgatgtattaatctgtgttttcaattgttttccaagtacagttcaaataacttgcatatttactatacaaaatggttgacaagtgttctttttgcaaagacttgaatacattggcagaggtgctaatcacatcttccctaaggcacctggaagaattatttgaggaaaaaatgagttttcacattgttttataggaaattaaatttgtccaaagatttggagactatttttaaaacataaatacataaaatttcattatttcctgctatcttgtttgctggcagaagtgaatgtttggtgaggttattttgggataaat

SEQ ID NO: 16198 - DNA, 1149 bp, Homo sapiens
aagccataggctcaattttatgtccttcttacttacacacagtagccccacacagttttgttttaaatgaaggcaaaagtagacatttttaaagtatattcaacattgtgccattatttacctgataaaggtgaaatcagaggtgtccacggcctcaaagtttgggcccatgggactatcaaatccgaattatatctacttagagcttagaggaagaattaggtatcatgagaaaagcaactcctacttgagagaaagaagactaccaaagcatgttgaggctttaacatgggagacttccaggtaggcgttaacacttgagtggtaactagcttgatgaaggaaaataattactttagcagttatgttgtaaaattaataaaaaggactcatgtttattctggtgtatttgtcaacccatgggtagtgattactccgtgtacattctatagtgtgtgtattttatttagtgtcttaatatatagtctttatatagtatcttaatattatttactgttacttctagtcatttatgtagtatattttactgcaaaatttgtagcactttactaatattagatcattattttccctcttcccctctacctttctggcattttctgttatcttagagtcaggaatctaaaggtctaagtctagaaatctgttggaagctgggttggagctactggatatgagttactttttacatgtctccttaagaagactcttttataatgtaatacttagaagccaaatcctttcaaacgcaaacacccttgaaacttgatgctttctgaagttgtattcataaaaattatcccatcttacagttaatcagaagatgttcttacctttggtttgcctgcctcctgaaacacaaacctgcagattgcccctaacttcagcagtgcctccgtcactgcatgtacctaaaagacaggaaagccaagttctgggagctgtcaagtcggaggatcaggaaaatggtggggaagaggtgactggaaaggcaggcactaaagatggcaggctgcaaaagcattctgagttcccctgtaacagataggttttatgaactcagctgttttcttttttctttttttttcttttgagatggagtctcactctgagtctcactctgttgcc

SEQ ID NO: 16199 - DNA, 1363 bp, Homo sapiens
cgcctcactgcaacctccgcctcccaggttcaagctattctcctgcctcagcctcccaagtaactgggactgcaggcacatgccaccacatccagctaatttttgtatttttagtagagacggggtttcaccttgttggccaggatgatctcgatctcttgatctcgtgatctgcccgcattggcctcctgaagtgctgggattacaggcatgagccactgcgcccggcccaaatcttttattttttaacagccttagttatttataattcaaatgcactaaaatatcatcgctgtcatgaactttgctgtttacaggttctgtgtaattcagaatgctttgtacttagaaaataatttctaggcttatcttgttttgcagttttcatgttttgacaattgcccaccatttacaatactcaatttttgattatgaaatgaatagtaaaattcaaacatatctaataataatttgccttagtttgattaataaattatatcaaaaaacttggggatagaaagaggcttttttttccccctgtagtatttttaaaactttttagatgagctggatgaaaccttagtacattggagctggagttgtattgagtacagccccaactctgaagccttatattcatgtcttaagtaccattgattgttctgtgaattgttgttagtttcatatttgacattgtagtaatccaccttgcattttagtctttgcaaaaaggatattgctaggtatattcttatttctgattgagtattgaatttacatttttcagaatttcattctttgtcattataatccaaaaacaatgtccacatcagacttggaacttctcacttcaaaaatgaaatacagatttagcagtgttgtacataatgatgtccaagcatttttccacctgtttactgagttttccaaccatttactatgtgttgagattggtgggttttctggctgtttttctgaggtgaatgacttgttacagagcctcagtaagaaatttcaactaaaatcacaaaaacataaagtccaggaaaccaccagaagatggatttttagtgtttttgaaatcttgtatttccttttgatatcatttactcattttaattttacgactgccaacttgttacggtattaattatatgtatgtgtttatatgtatgcatataatatatgtatatgtatatgaagaataaagttaagatttggtcaaactatattttcccattcaagtacaaaaatgttttcaaggctgcaaaaagtgtacagttgttaaacaagttgtaaataaagacttgtataaaaattcagcctagatttcttttttctgctcttaaactctgacaaatat

SEQ ID NO: 16200 - DNA, 1219 bp, Homo sapiens
tgcaccactgcactccagcctgggggaccgagtgagactctgtctcaaaaaaaataaaaaataaaaaataaattaaaaaactaaaaactttaccattgtagcctgttgattacaagattgttgtatttctaagaaattacattataaaataattggtttaatgggaaaagagattaaatggagagttgcagaccctcactaaagttatttaccctgtggaattaaggtgcttttatgtaaaaatctgtagctataaaattctgacatcacaggcattagtgtttgattacatcgagtttttgctaaagagaaattgcttttcttttctggatactgcacactgtcattagcacttcatcacccactgttatgtaaaacacaaaaccactcaaagtagctgctatggaaagcccagcagttttgaaattgttgtacatttctaattatccgctctgttcgttttataaccagtgtagtacaggcgatgcaaattctgtatcccagttaactaatcacttttattaacttctaactgaaaacttatgctataacataaagccgtgtaactccttaaatccgagaacatcagcatgaactttttcttcctcagtttgatatcctggaggatctgattcttagcttttctaaattactgaactcaccagcaacctggaaaaataaaatccagctagtgttcactgacttggaagatttctaaaataaatttggaaaccttctgtctaggcttttgtttttggtagtatcttgtcttaatctgtaagacgaattttttaattttccaggcatgtagaataggtcattcattaagcattaaatccttccctttttcctattgttctgctcacttttagttgaatgttatactctaatatagattttttaagggtccgttttattgagatatagttcacttaccatacaattcccccattcaaagtatataattcagtgttttttagtatatatacagatctgtacaaccatcaccatagtgagttttagaacattttcactaatagatttatataaatatttcagccaaagaaaattataaaaatggaacccaatataaaatccttaagtattttcctagcgcagaaactcctggccgggcgcggtggctcacgtctgtaatcccagcactttaggaggctgaggtgggcggatcacctgagggcaggagtttgagacctgcctg

SEQ ID NO: 16201 - DNA, 2144 bp, Homo sapiens
tttaaacttcatttttaaaaactttttctacttagcttgtaattatcctttttttttttttttttttggagacaggatctcactctgttgcctaggctggagggcagtggcatgatcgtggcccactgcagtctcgatctcctaggctctagtgattctcccacctcagcctcccaagtagctgagactataggtgccaccactaggcatggctgatttttaaaaaaattttagtagagacgagatcttgctattttacccaggctggtcttgaactcctgggttcaagtgttcctcctgcctctgtttcccagagtgtttcccaggcatgagccactgcacctggccagctcttaattaactaatgatctatgataagactcatgtaatttaaaagtttcattatagtttcagcgtcattcattcaaaataactctccttttcttgtttgtgtttcagggtttattttctcttgatctttctactgcttttgttcttccttcacaaaatcaagtctttgttttttgttgttgtttacaggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagaggtaagctggtggggctcagtgctgtcatttttggtatctcagaattgatctgcccaataccactaatatccatgtcccctttcaacatcgttcctcagaattcagtgcagggctatttctggttaggggcagcattgacatcacttggcaacacagccggtgactcttaatagtgtgtcttcatttgaatgtgatttgagttaaattgtattggctcaaaggcatttgcgcttgaaattgaattacatattactttaatttttatttttcattttcagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaatgccatagaagtttgattttttaatagcattgaactatatattatacaagacacattgtctcagcttagaaaagcatttgagaaagaaaatattgctataaaactgtaaactagaaacatgatgtgttggaggaaatgttaaaatgtaaattggtcagttcttgactgaaagtgacaaaatccactcaaggtagtttaaacccaaagggtttattcaggtttataaatatctcacagaagaattgcctgatcttttagaaagacattcccaaaccatgctacacaactggaccgtcccgttgctgctgcctgtgccagaatcaggaaactgctggatgaggagtgaggaagccacgatcctggctgccagctccaggactgtgctgtgtctgcacgttccacgcaaagcacatctgctgcttttcccatgtagtgtggttccaaattaaaggctcactgcagtgcatctgattggaaggaaccaacaggatgtcttaaaagcttaactgcagaggaatctgggaa

SEQ ID NO: 16202 - DNA, 1320 bp, Homo sapiens
cccaggttcaagcgattctcctgcattagcctcctgagtagctgggattacaggcgcacaccaccatgcccggctaatttttgtattttaatagagacggggtttcaccatgttggccaggttggtctcaaattcctgacctcaggtgatctgcccgccttggcctcccaaagtgttgggattacaggcgtgagccaccgtgcccggcctgaggtttttttattcttgtccctctgttcgcccttatgaggtcttgtcatttacatatgcttttcaccttcctagtggttatcttggtcctgggggcattggagattttggcaagtatccaaattgcactggaggagctgcaggctacatcgaccgcctgctgctgggagacgatcacctttaccagcacccatcttctgctgtgagtgagactcgagttcgcttagaactggaactcaggctttcagaagtgaaggaaagtagaaagagccagcaaacgttaaaccatgcccatttaagaaaacacactgagaactgatgattatttgaaaagtcagctaacttaatgactttagggatcactgtatggcagtgtgtaaacattattttggattttaaagtgagaatgtggagctggacacagtggctcacacctgcattcccagctactcgggaggccaaggtgagaggattgcttgagcccaggaatctgagaccagcctgtgcaatagtgagaccccgtctctgtaaggaaaaaaaaaacaaaaaacaaaaaaaaaagcaagtgagaatgcattgtgtaaatgatcatagcacagtgcttttctgtacgtctcaggtcggatttcctggcagcagaccctgagacagagggtcacatgcaggaagtggatcaggcagtccttgcgggggaataaaggaggcaggaccgtgcagagggagaagttgacctgcacggtcaactttgtaggtagccccagcaaaggccccagccaatcttgggggcaccggggtggcgctgcagaattgttctgaattgaggcaaaggtttgggcccttcctacccctggatggtgcggaaggccccctgcagaaggctgatccctggagaggtagctctctttagtcaagggcagatccagaagaggcacctgtctgagagctgtggtcatgaatacttccagcagctggaggaatgaaggttttgtgctgaaagggttggagggctctgagggtgtgtgacagcacctaattacactgttcatttccagatttctacaatttctgcagtaacatttattttataataaaaaaagaaacatatttaaa

SEQ ID NO: 16203 - DNA, 1166 bp, Homo sapiens
aaaaaatgttgattaatattagctattactataaattatttttaaagcttctcatcctttgatgttttcaaaaatgaatacctaatttcagagggattgtatgtgaagtccatatttcactgtttttaaatgtttccctgcctcccccaccctgcctctggttccaccctgtcccggtccctcttcctagtgctgcccagactgggtcaccaaacaggcctgtctgacggaacccttgtcacctttgtggagaattctctttgggccctgcctggaagtaagagccacggagcctgcccaggtgccccttctcctcctttccccatgacctgggcttctgcattccctgcagcagtggagatgtggtgtggctaccatgcttcccccgagctctgtgcctgctgccccattctgctcaggagcctcttcctgcggggaccctctggtgctctggcctcacctctgtggctcgtcctctctgatgcctcctcctccccagagagggcgttcatctctggtcccatgctcctctgttagtctccactagtcaaaggcagaggtgatgtttcccgcctccctgtaatcccagcacctagtagcgtgcccagcaagtgaatctctttgtcaggtagttaagacagtggattaatatgaaataaaaatatccctttggcgattcttttggtcacactgtgttatctcctccaggcaggaaaaatactattgtattacaaggctcggaccaaagacatcctgattcgattcactgcttggtgttgtattcttgtaagtaagcagcattcctcgctaaaattcctttccttcacatgtatagatatttaaaaggaataaaatgtttagcaacactgagctagccattgtcaccacatggcagcaggtaccattttcttcacttgaataacagagaggaacaaatctttccacctaaatgcacagatttattttcttaggaaaatgtctttatcaataaggcagtgtttgccatcagatagccaggaatgcctgaagaaatgtgaggtatgggctctgtgtggagaggcgtatcagagagactgggcaaatcagaccaggttgcagacatcaacttccagattatatgggaaagagagttgcaaggttgactgtttgttcatttcatcctgacc

SEQ ID NO: 16204 - DNA, 1126 bp, Homo sapiens
aacctcttggcctttgcggcatccagccagaaattcatgaaaactacggcataaatggataggaggagaagcgcctgttccatggactggcattttagctgccctcatgaaataagaaactttagcaagctctagttatattctaatgagaaggcatttaattatttctgtatgttgtatagttggtcccttcactttatggagagcagcaaatccagtttcttgtgcagacatagaactaaatgtgtcatccttttacttcatgtttcttaggaatttaatggttatgtgctgtctgttttcctatgccttttggctcaagtaacatatagcaatgttgactttttcttttttagatctagtaaaacaacaacaacaaaacaatctttgaagaaaggaagggattaagtatttttcctctaatactttcttgaaggtcaatgaaaaagtggtaaatagttatatgtaacctgtgtgaagcagcagccagccttaaaggagtccattccttccaaggcttagaacagtgactactgctgtaattgcttaggctgctgttagtttctcttaatcaaaattactatgtgatagaattcatgttattacttggtgtactgaaaataatttaaaagtaaagactctgtcgtgcaagaaaggaaaaaatgagaggcaaagaatgttaaaatagaaaaaatgtttttatgagagagttaaccttttaatggcaactatatgtgaataaaattaaaccatcacttaaaatattcattagaatgaataatagaataaccaagttcataattagtaagataaaatatattgttgttttttcgttattttttaattcatattagaatttctgtcagtgtttgaacattcatatttatagtttgtacattttcaccttccaaggtttaaaatgagaaccacactacatcacaaaaggtaactaataaacatttcacaattgtgtgaatatccactcactctcactctcttaacttctttccttaatttctttccttgctgtaatttacaatgaagtgtgccccactcatatctcagcaaagtttcagatattatggattcatcacatgtatattcttttaaaatatacttctgtcaa

SEQ ID NO: 16205 - DNA, 1212 bp, Homo sapiens
agtcccatgtggactggattattaatattttctcagttgttttaaaagttgattcttccagattctactattaacttacgatatcagtttagttcattggttctaactttagcatacattagaattgcctggagatctagttaaaacacagattgctgggctggccccaccctcaatttctgtgtacccctggggtagggccagataatttggatttataacaagtgcacaggtaatgttggaacagctgtccagggaccacactttgagaagcactgctttacaaggtatattgcaaaggaaacatgaaaatacttagtgctgttcttttaaggagaactttttaatttttccccacatgaaaaaatgaacatgagcagcatttaggacccatttcacctatgttattttgattgcatctaattataatacattaaaaataagtcgaatgccttttagtgagatttctacatatatctgtgtgataaagatgagtttatgatttctagagccttggtagctgaatgttgcatgttggagagggactaatgacagtatgctgtctctgtgcagaggatttccaccttccgcatcattgtgtttattggatctggtcaagtggcttttagctcattgtgggaggccccagacagaatgtcgacacaaatccattgaactcttttataaattcgttcctttattgccaggtatggtaatctgtatatctttaatttcaccacggtgctttattatcccatttaaaagaagtaaagaagaattgagtaattgggtatcattgcagttaacatggtattcagttaagattcagaatattaacagttgatgaggtaatgcagttctgtttcagcatgtgattaataagaaattgccagcatcctaagtctgaatgatctcaaatcatattaaaggaaagcagtgaacctgtgcttttcagtaattactaaaccattaaactgcttatggactgaaataatgacaagtttctcaggaataaatgtattgctcagttttgtccattaagtccaaacctaggtttgatagcttgggagtggggaagctgtgctcaggacagatcaagccctgccttcccccattgtgggctgtcacagccctgtgccatgtgtggagagtgcctcaggttagatgggtgtgctggttccttggcaaaagttggggtggagtttttttttt

SEQ ID NO: 16206 - DNA, 1523 bp, Homo sapiens
cagcactttgggaggctgaggtgggtggatcgcctgagctcaggagtttgaggccaccctgggcaacttgatgaaaccccatctctactaaaatacaaaaaattagcccggcgtggcggcgcatgcctgtaatcccagctactcgggaggctgaggaggcacaagaattgcttgagcctgggggagtggagattgcagtgagctgagatcataccacttcactctagcttgggctacagagtgagactctgtctcaaaaaaaaaaaaaaaaaaaaaactttccatcgtcaaaattatagtaacgtttccctaagggaagacttcctttgactcagctgattggtccccagccgttccctgggccgacctaaggactagggacagcacagggtgagtggggtgagtggatggacacgaaggccctttccacaccaggcaaagatgcttctccctgatggcgctcacagggtgcacattgactgcacatctgtggtgctcaagcagtctttagtacgtcgtttgtaggtgtattggtgtctcaactaggaaaacagtttttttgttgttgttttgggtttttttgtttgtttttttgagacagagtctccctctgtcggccaggctggagtgcagtgacgcgaacttggctcaccgcaaccttcgccttccaggttcaagcgattctcctgcttcagcctcccaagtagctgggattacaggcaggcaccaccactcctggctaattgttgcatttttagtagagacaaggtttcaccgtgttggccaggctggtctcaaactaccaacctcaggtgatccacctgcctcggcctcacaaggtgctggaaaaacagtatttttactttgttttcttaggtttgatttgatcttcctcttgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggtaaccctgctgaaaaaaggcttactgtgcctgtagcccacagcattaatgtaactgaccaatcatctcctttaaaatattaattattttgttacgaataacatactgttctcttccttgttttgagacagagcctggctctcttgcccaggctggagtgcagtggcttgatctcggcttactgcagcctgtggcctgtgcttctgggttcaagcgattctcctgcttcagcctccctattagctgggattacaggtgcccacaaccactccggctaatttttgtatttttagtagagacagagtttcaccgtgttggccaggctggtcttgaaatcctgacctcaagtgatgcgccagcctctgcctcccaaagtgttaggattgcaggcgcaagccaccatgctgggcctaagaataataaacttttcttttttttt

SEQ ID NO: 16207 - DNA, 1300 bp, Homo sapiens
aaaaatacaaaaaattagccaggtgtggtggtgggtacttgtagtcccagctactcgggaggctgggcaggagaactacttgaaactggcagacagaggttgcagtgccgagagcgcaccactgctccagcctgggcaacagagcaagactccatctcaaaaaaaaaaaaaaaaagaaaaatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaaaatgtttaaaatgctttaagatgacacatagagaacatacacatacatacaaattagtgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaacttcttgtcctgttaggtcagtgttatgatttaatggttttaattacttaaccaattttaagaattgacaatttttaaaaatatttttttctaccattctaaagtaatgtcttttgttgtgggtttatgtgtaactacaggattttggaacataaacattttgaaggatagtcaatggtatttagtc

SEQ ID NO: 16208 - DNA, 1969 bp, Homo sapiens
tgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaatgaggttatcttaactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtgga

SEQ ID NO: 16209 - DNA, 1496 bp, Homo sapiens
gtccttcatagcaggccaagtattgcctctctgcaatagacagctactgtcaatacatgctgtaatttgacattctgggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctgacttttctgtgactttgagtattttaatatttggaatgttaacatttggaatgaatgtctataatgcaatggaggaaaataacaatgtacttaaaagaatatatattcagagagagaaattttgatgatggtgtggttgacttagaatggaaccaggcataagaaataatctcatgttattcagttttaattggctaaaaaaaaatttcccaaatttggttttcaatgtttctacctatttaagaagttttatttggtgtttatcttttgtctttttcttaactctttttaaattttattttattttattttatttttgagacagagtcccattctgtcacccaggctggggtgcagtggtgcgatctcggctcactgcaacctctgcctcccaggttcaagtgattctcctgcctcagcctcctaagtagctgggattacaggagcccaccaccatgcccagctaatttttgtatttttagtagagacagg

SEQ ID NO: 16210 - DNA, 1154 bp, Homo sapiens
acctgaggtcaagagttccagaccagcctgaccaacatggtcaaaccccgtctctactaaaaatacaaaatgatccgggcgtggcggcatgtgcctctaatcccagctacttgggaggctgaggcaggagaattgcttgaacccatgaggcagaggttgcagtgagccgagatggtgccattgtactccagtctgggcaacaagagtgaaactgcgtctcaaaaaaaaaataataaaaattaataatcaagagaaactctgtaacatctctatggtacagagttacatctctatgttagagttacatctctaggtatgtctatgagctaatatttgcatctcactttttaaatttaaattttcttttagacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaactgagtctgtgtgggttctgtctcaaagatacaaactccctgatagtctatggaaggaaaatgacaactattttagaatatttctagtttgttttttcagtgatcttttcatccaggccttgttactgttacagatcagaatgaaatgcacaagtggaatgggattgacctgtaggcctgctctgccgagatgagagcagatggaatgagttggtgacccctcttaatctgtagcctcagggaaacacggctacccaatgccaag

SEQ ID NO: 16211 - DNA, 1128 bp, Homo sapiens
cttagatagtatatcacttgtttgtggagctaaaagcccatagtggggctttagagtattttgtttaatttaatgtcaaaatagacttggattctactttcttttatagttcataaagtgcattttatattcaagttatttatctgatataggtatctatgaatactagaaataaagttaaaataaaaaagaaaaaacatcaaaagaaatacttagatgaaattgtgcaagaatcttggagaaaagaatatgaagaagacgacattttggcttcagatgatccatcttcaattgaacagtatgagaacaccagaacatatgaacttcaaagcaaaaaagatactgagacagaaaatcctccagttgaaaacacattatctccaaagctagaaattacagagaaatgggaaaagtattggaatgaatatggaggaggactattgtggcaaagttggcaagaaaaacatccgggtcaagcactatcttctgaaccttggaactttcctgatacaaaggaagaatgggagcaacattatagtcaactttattggtattatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacctattatggttgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgagggtaagattaaccaagatttattctgccatgtaatggttagcaaaatgaattcatttagcaaaataactactaatcctttattgtagagttaaataataccaagtacatttcatataataatgaaatgatttaatccatcctgttttcatatca

SEQ ID NO: 16212 - DNA, 2525 bp, Homo sapiens
tcctttccagaaatagatgtagatacttctgctggactgggaagccaggagctgaaatatcacaacaggacgtttcaggctatgaaaaataactgcttactaattctaacgtaagttatccagattacgagaagcatttctgccaatgctcatgtcagctaagctcagagaagttacctcatcctcagagagcaacgaatggtatggtctatgtagaaagcaaaatttgcaacggaaaaaccagagttcgtgtgcactttatgaggaagagggttaggtgcaccagacagaggagtttctcaggtttccgtgtcgcctgttctctcgaccaggtggccctctcggcgcaggcggggaccccaccctgcgggacttcggctcctccgtgcggacagggggcgcccgcagccgtgcctttcccgccaactccactagtgctccagctcgcccttgtgcgaccgcctctagggcccgggatatttcctgttccggggcgtgtgggacccggatgcaagcgtgctatataagcgttgctcaagtcccacccctttctttttgaggaagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggtggggaaacgcgggaagcttccggaagctgcctttctccagaagtggcagaccatttttggcttattgttctttttcatgtatctaataataggcttttaaggataccggaaaaacacccgtggagccggaggtggcaattcaccgaattcgaatcaccctaacaagccgcaacgtaaaatccttggaaaagggtcagtgcattcgttatgcgggggggagggggaattgggcgaaaagcgacgagctttactcgttaatgttagtgtagaaggtggactgcaagaactaaagtgacaagttacttaaaaaagtaaagcgtggcttaaaattgcttttactgtcatacagctggcgatgaggaggtacctattgtgttgagtaacggtgataattttatacgctattctgagccagcagaagtgaaggccttaagccgattttaattgtttcgattatactgagaggtcttttatttcctgtagtgtgtgctgacttgataagaggcgcaaaagaaaagaatctcaaagtgaaaggaccagttcgaatgcctaccaaggtaaagtaaatcggaggggcaggaagtaggagttgcttccggatgttgcataaattcaggttctttaaggagttcggctgccaaaattgttaacactgatgctgtctacaaacgcacatagaaatcggtggtagattgcggttcctagtaagtagctaatgtttagatatgattgttgaattattgttgctgtgttcttggtgtgctttggtgcttaacaggcgcaagctctaagggtggtgtcctagcacagtgaaaacagacctggcattttcaacccatggtacctgaaaatctattagtgtaaattggaatcataccaaagggaaactaatgaaatgattagaagtaatgattttccagatgttctagggataagtataaaacgataaacacttggtttcctttgtcttttgttacagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacttctgttggtttttattcagaatactggcagattttaggaatataaaggtgtactatgagacttccacttttcaggtggaatatatgggtatcttagagtggtctatcctgttttcgttgtcgtttgagtcatttgaaaactggattccgttaactacataatatgtgagacctgactggttttattggacactggcagtttataactttggcatactctagataaattctgattggtatggggtgttaaggtttctggggcgtttgtaatgcacacccatggttgagaacctagtgcgctagtaggcacgtgttaaaaagctagtaactaatatttttaaattaaccaagtttaacgtccttaaaaaaggattaagtggcagaggcaggactaaaactaagttttagggttttaggaactaaaacttagtttaaaaatacttatattttcagtgttttatattttaaatataaaattttcactttttttttttggggggggggacggcgttttgctctg

SEQ ID NO: 16213 - DNA, 2525 bp, Homo sapiens; identical to SEQ ID NO: 16212

SEQ ID NO: 16214 - DNA, 1961 bp, Homo sapiens
catagtagaaaagtcttcctaaagccataaataaaacaattgatgttttcaactacaaaaacagggaacatgtcttcatagaaagaaaattaacaatataaataaagattaacgagaaataacaaactggaggagaggatttgtacctcatattacagcaaagggtgaatccctctagtgtaaaaagagtttctggaatttgacaaggaaaagaccaacagatgaatgatcagttcacagacatagaaatatgagtgattcttaaatatatgaaaattgctaattaaaactacctttcaataccattttccattatggccaaaatacaaaaatttgacaaatataattggtgaggcatggggaccatggggaaatgcctaggcactcttggatattgctggtggaagtacagactttagggaaaataatctgggaacatctattaaaattacaaaattgctggtgtgattccatcctgtgcagctgttctcttgagcagtggtcatttatctctgtcccccttctctgccacctaagtgcgtgctgccacccgatggaagatttgatggacatggacatgagcctcctgaggccctagaactatcttttcggttgtgaactgaaggccaacaaagattatcactttaaggtggataatgatgaaaatgagcaccagttatctttaagaatggtcagtttaaggctgggcgcggtggctcatgcttgtaatcccagcactttgggaggctgaggtgggtgcatcacgaggtcaggagtttgagaccagcctggccaagatggtgaaaccccgtctctactaaaaatacaaaaattagctgggcatggtggcacatgcctgtagtcccagctacttgggaggctgaggcagcagaatcacttgaattcgggaggtggaggttgtggtgagccgagatcgtgccattgcactccagcctgggcgacaaagcgaaactctgtctaaaaaaaaaaaaagaacggtcagtttaggggctggtgcaaaggatgaattgcacattgttgaagcagaggccatgaattacgaaggcagcccaattaaagtaacactggcaactttgaaaatgtctgtacagccaacggtttcccttgggggatttgaaataacataaccagtggtcttacagttgaagtgtggttcagggccagtgcatattagtggacagcacttagtagctgtggtagaagatgcagagtcagaagatgaagaggaggaggatgtgaaactcttaagtatatctggaaagcggtctgctactggaggtggtagcaaggttccacagaaaaaagtaaaacttgctgctgatgaagatgatgatgatgatgatgataatgatgatgatgaagatgatgatgattttgatgatgagggaactgaagagaaagcaccagtgaagcaatctatacaagacactctagccaaaaaaggacaaaaattaaatcagaatggaaaagactcaaaaccatcattaacaccaagatcaaaaggacaagactccttcaaaaaacaggaaaaactcctaaaacaccaaaaggacctagttctgtagaagacatcagagcaaaaatgcaagcaagtatagaaaaagtgcattgaacagtcctgggcactactggtaaattaagcccaaagatggggagaaaggaaaaggagagaccaatatagtccatactgagtgtcatcaacaatccagactgaagtcttctattttaatcccaatccccttttctgatttgccacccatgcctcttcaggctggaaacaatctcactcttggttccctaaagcactttcttctgactgctgtgattcggtgaaccttgccctttgctttctattacttgtgcatttgcatcacctctgaccatgttttttttttttttttttttgagacagagtctcactgtctcccaggctggagtgc

SEQ ID NO: 16215 - DNA, 1157 bp, Homo sapiens
agccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttc

SEQ ID NO: 16216 - DNA, 1252 bp, Homo sapiens
ggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttagtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaagagatggtgtgctgcatctgcttttttttgcgccccccgcccccccacctttttttctcattgcggtaaaacacacataaaaatttaccattttaaccatttttaagtgtacagtttagtggcagtcagtacatttacagttttatgcaaccacctggaaccatttccagaacctattcatcatttctaaacaaactatactcattaaatagtaactcttcattctccaccatcctcgccaaccactgctaaaatccctgtgcccacccctgagccaactcctggtaactcttcagctttctgtctctatgagttcatctgattt

SEQ ID NO: 16217 - DNA, 2577 bp, Homo sapiens
gtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttata

SEQ ID NO: 16218 - DNA, 1214 bp, Homo sapiens
tccctcttgcttctgctcttgccatgtgatatgctgggtccccttttgccttccactgtgattgtaagtttcccgaggtctcaccagaagcagattctggtgccttgttgcttttacagcctgcagaaccatgagccaaagtaaacctctttgctttataaattacccagcctcggatatttccttatagcaatgcaaatggactagtacacccaacaagcaaaaacacccatatcaattttcagaactttctccgaggagtttattaataaatatccacattacctttttatcctcataggaattttctagtgctgatttacatataaattgctgtcttaaaatttaactttctaaataccagaagctctccaagataattgtgacaaccaaagcatccctatgttgagaaccagtaaggagtaatgtgaagtgactttaaaaaagatctacaaggactgatcagtcattatggaaatttttgtgttataatttaagcaaaaaattctgttttccagtgtagctcatgaaataattacagtaatctcaacagtgtagtttaattcttggaaaacttaatgataacttttttcccccctttttaaaagagagattcccctggagcttcagcgccttgttcatggtggccaagtgaatttggatatggaggatcatcaggatcaagaatacataaaacctagattgaggttcaaggcttttagtggagaagggcaaaaacttggaaggtaaaaatcctaaaatgagaaaaatacctttgttgaacatgaatttttctttgagaataagaaaagcaaaatgacctatgaagtaaaaaacaaaaatatgaaccatgcacattagatatatacatctgttaatattatatcataatattatatcatgtgataccattatatcataatattaattgtgatattaataatactgtaattaatacttagattgcagttaccatgtttgtggccctctaagccgtatacatgtgttatctcacttaatctttacaacagctctttgatgtagatactgttattacttcattttgcagatgcagtaatttgcccaagattgttgagctaagaaatgactagcatgtgggattcaaacccaggcactctgactacagagtttgtgcttttcaccactatattatatgcctctttcagattacctggtttcaaaggagagaattg

SEQ ID NO: 16219 - DNA, 1196 bp, Homo sapiens
gtagtgaagagatcatttttcagaggttttctgcagtaaattcacagagggatatactcaaaaatatacaaaggaatatacagttactcaaatgtattataattcaagtaattataattatgtagtcagagccttataaagtgtagtgtgaaataaatgccacttgtgtcaaaatggtttataggatgataaaaataatgacagaaaaataggaaataatttaaatgtaagaatagtttcaaggcctatttattttggggggaatgagtttagctaagggttatttggtattatttacttgtctgtcatggcttctgtggtagataatctcacctatttctttgaaaaatgagtttttatcatgccatttctaaagagtcagttttatctaagcaatcaatttatattaccatttttcttatattaaatgtagtgtttagacaaatgtcatagaaagtcacactgtagctcccttagataaacctagaaagtagatcaatttctgatttttcttacttttgctgaaaaacctattttcaggttccaaaacatttctgaaaagctgcacatggaatgcaaagcagaaatggtgacgcctctggtgactaatcctggacacgtgtgcatcacggacacaaacctgtattttcagcccctcaacggctacccggtgtgtagaccacagggtcaggtggggagctgcccatgtttaagctgtttccagaccatggcctcacaatgccagggacctcactttttgatgaggatcaagtcatgtccctgcccacccccttcacaggcagcatctgtgtattttacaaacaccgtgtgtaatcgtgatgtgtagtctctgaagtttgagttcttctgatctgttttcagtcatgtcaggggcacttgctctcagtgtggtgaaaagaaaccctgctcctccctattttagtaaagggtcgctagagatttagacctttcttctaggaggcatttcctagagaccagtgaaatatactatgattaataagaaatagattttgaaatatatttgcttatatatacacagatgttggtatttcttgcttcttcttaatgatgaacaacctcagtagatctgaatttttcctgaaggagcactatgagcaggtcctcccagctagtgcagaggtgtgtgtggagatcctgccgtctggcagttatgg

SEQ ID NO: 16220 - DNA, 1880 bp, Homo sapiens
ttttacgttgtattaaagcagcatgggctttgggtatttttatgctttaaagattacttgcaataattattttaaatgatttctgcattatgagaatttcctgaaaagcagcattatccaataactgtttaccccgtacctggtatgataaagaattattttcagaaacatttccacagtgtttttaaaaggaaggaacatcccttaggagatattgttttaattgttgctaaaatctacttgctgtatttttctcagttgtttgataaaattgtatcataaagaattaaatgagttttttaagaattagttaaactatattgtctggtcatatttattgttctgttctcttttatttcaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaa

SEQ ID NO: 16221 - DNA, 1179 bp, Homo sapiens
tcttactgacatgcatcatcctaaacctaataagacaggttcgctggccttatgtatatggggatttttcagccagccatgcgagttcctgcaggactgatgctattcacagagtggatgggggtggactcagtgcacccctgcagaggtcataaaggaacattgcgaatccttctaaatgtcaagcaaaattagatctggggaaaaatagggtcagaaatcctcccaggcatcttgcagttattctgaacctgtttttctattagtgtttgtggtaattctgataatatccctgaagtgtaacttggctcccagtagcttccctagaaggagcgttccatagaatgatctactaaaacaaggtccacttggattcaacagagatgctaaccttgactgaaaaacaaacttgtgttgtggcagtgctgtgattttgccagtgatggggcctttctttgtttctgtgtgttttctgtgcacggatgggcacggcacaggctatgagaagtacaactccatgcgagctgaccccgcgctgtgctttctggaacgagtcggtatgcctgatgccaaggccatagctgccgagcaaagaggaacagacatgctagcagatggtggtgacgggtaagaaggacattttaaaatttgaataaactttatgtcagtttcacatctattggcagggttcagttcttaccctgcagtacacactgtattgtgtctgatttgaagttcaggagatgtttaccagtctactctatttgtatgtcgtaatgactgtttaaacaatatacattatcttgataatctgaaacttgtttttcttttccaaatgtcatttcccgcaatctccccagaccccctccaccacactgccatggctgcatgttttaaatactgatagagttgcttttgatgtcaaacccataattaaaagtagcactgggcagattattactctttcctacccaccccccttccttcttttgcttatcagtatgattcaaataatttttgtgtttgttttacataggggagaatttgatagagaagatgaagacccagaatataaaccaaccagaacaccgttcaaagatgaaatagatgtatgaacttgagtatattggcttttatagctccattaaaatattatatgcccacataagacttgttaaa

SEQ ID NO: 16222 - DNA, 1071 bp, Homo sapiens
ttgttacctggaattctatgtcaattcccaggaaaaggccatagagtagccttttctttgacctgaggataattgaagaggcaaatatattagtaataattatgaattcatttattcattcatcaaatatttattgagtgcttcctttagctagacatggccctaggtgactgggaatatataatggataaaatatataagcttcctgtcctgatgtgtaacatcctaatgagaggaaacctgtcccccaccacatatacttaggcagattagcacttggccagaggaagaaaatagctgtggagtggacaatggtgtcttcagcggccgaaaggaggggcaggggaagccccagcagcaggagcaggtgtgtggcagcccttcacaaggggctttcatgtctcagttgtatgttgccagtgtcactttgttcattgtcatagttgagggagaagacttgcaacaagaagatggacccacaggagaaccacaacaagaggatgatgagtttcttatggcgactgatgtagatgatagatttgagaccctggaacctgaagtatctcatgaaggtagaacacttttttttcaagttttaggataaaatataatcaatgacttctaattactgaagtttttcttaaacccctttaaaactgatatttaacttttgcttagatttttaaaagttgaagcttaaagcttcaattaaagcaaattttttcttaaaatagataccttgattttggttcaaagcacttttcagggaaactcagaatatacaaatttcttataaatagtgagtcaaatacttgaggaaactagttttactatattcttctgcttagggtgctatttgttaaataaaattcaaacaactgatgaaatattggacttgataatctatcacaggctcatgttcacacatgaactctgtaattacagtgagcaaaacacaattcttagcttctgtaccaggcattggcaaacttttttttgtaaatagccagagagtaaatatttcaggttttctggatcgtacagactctgttcagctactcaactctgcca

SEQ ID NO: 16223 - DNA, 1249 bp, Homo sapiens
ccttaggcctcaacggatcttgtaaaggagtaggaatggattgtgctgtttcacttttctgtccttttctctctggctaagaatatggaatggtttagggggagatattttcttctgtgtgttaacagagtttttaagattctgcagaaatgaaatgggacggagaaaaggatttggctacatttttatgtgatttcattaagttgtttatgtgctctgcctttggaaagaggtaatattcaggtcattttgatgagtaacttggatggaatatacatattatactaaatctttaaaaaaattcaggagtttatttcctgcactacttcaaagttagtgttgcatctaaacaatcttttctgttttcagaaatattttgtgtgacgtgttttgagaatttaactggaaactgtttttgaaatgatctatcattgtacataatcccaaattattggagaaataattgtgagaataagtgttcagtaaaatgttttcttcttatgatatcttacatttatttctaaacagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggtaagaattttgatatccttatgtgaatttgtaagagagtaagtgacatctcttaggagtcttgaatatttgttatcatctttctggtactggtaatttctatagcctttcagtggttctcaatagagtgaggctgaaaggggatatgaagaaggttaccttggagtattgtcttttgaactctttaaatgtgacctgtaggtttttgaaaaaaggctttatattgtatgtctgtcacacagggagaagttttatcaaacagtactcattctcactatatgcagtactttttgatttctattcaattttgttatattataaattttaaaaatacttgatcatgagccattacatttatttaaggacttgctaatggatcataaccacacaatatgcaaaactcttccttagagagggttttcaaagtacacccttctgtgtctctgttgggatgggatgagtacgtgtgcacacatataggtactggatgggtgtgctgagataggcgtttgtagatattattgtgtgtgtgtaggtgtgatctgtgtgctgttctgaggaagttgctgtg

SEQ ID NO: 16224 - DNA, 1279 bp, Homo sapiens
ggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaaaaaaaactggaccctgcctgttttctaaaaaacactttaaagtattttaaaataaaagcatactatttaaaattgtataattaaaaataataaaagaacaaaatcacttaaaaagaataaacagtgtcaataacaaaaaacctctggcttacccaacttttgtttctagaagatttatatcaatcaccagttccacttcatttatttttgtttatttcaaacactttcttatgactctgtggaggagtgattagtttagtacccaaataaaggataacattttaaaatgtcctttaaattagatttttttggtgataggttccatagtaaatagaattaagataagtcagttaatctaggcatattttatgatggaactttgaagtgtttataaatgaaacaattcactgaagaacattaaaagaaaattgaaatgaatggtcaaattaataaagtgtcaaagcaaataattgtctaattgtctatattactttagtgattatgccagaagtgccttttaaaaggttaactgtattatgtgctcattgtgttactcaactgcacgtaatttatttgttttaatattgtttgaaagaaaataaacatctttcacataaaccatagtgtacaagttattttttaattttaaaatgtaaatatgaggcattctttttcaaaaactgcttttccttacagaaaaaaaaatcttagcacatctatttgtccatcactccagtgtcagttttttcttcataagtttaatgacaggctggtattccagctgcttagttcaacaccgtatttctctaatgtctttcgctgtacataaaggggaccacaaactaattactaagccatggatagtcaagaagttaaaagttttaagcaaaaaatgccatagtttgccacttaatcagataattttattttctttaatagacttcattttttagagcagtttttggttctcagcaaaattgagcatgaagtacaagatagagccatttaatttcgaaacaatatgctattagcctagatcatgatttcatttgtcaaactagatttttcttacagaaatagcactgaagtcctattacaaatatctttatctttgccaatcacctaaattaagactgtagatcataaaaca

SEQ ID NO: 16225 - DNA, 1155 bp, Homo sapiens
ccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggtaagaatatagtaattttttgtttggggtctttgtattgctggtggggtgcatggatgggtatattctgagtttaagaactttctgtgaaggaaaccaactacttaagaaacaactctacaaacacccttgaaggtatctatgtgtgtcctatatgaaccatttcttctttcctttcccagggtaactcacgctgagttagcctcttgctcattcttcatactccctagatgataaaggccattgggcctcagtgtttatcatcaaagctgaatgaattttggcatttgtaactaaacagacttcatgaactaaccaggggc

SEQ ID NO: 16226 - DNA, 1098 bp, Homo sapiens
tgtaaaatgttttgtggtaataatctcactatggtatatagaggtaattatcaattgtttttaattacttgaattagtacttgaactttatatggagatgatttacattatatgtgcatatagtttaaatctttaaataatgagagtttttcattgtaattctttttgtgtgtgtgtgttttttttttttcaggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaat

SEQ ID NO: 16227 - DNA, 1679 bp, Homo sapiens
ggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaaatcttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggtttcaaacatgtttaatttacattaggtttttatgtaagagtgtcatggaagcactcagcaagcaggctgattgcaatagactcagacatgcgaataaatgtaattgagagtctattcatggtgaggagtacatcccagtgcctttaacctggatttctaatcttaagtgaaatgggtgcagcattcctttggaaaaaaaaatctttttattttcaagtgataattttgtgtttttctcatataagttttctccagagcacccaccttctcttccttcttggtctgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaagctatcttatgtgggtattttattttgaaaggtattatagtttgtatatttaacagtaaggaggaaactgtaaccaaaattagtatttctctatacgtattggtacttgaagattcctttcaaaagaaatccagcgttttcctaattttagtacttaatttctctttttaatttaagtgatctttctaattcgaaagctgtgttctttttgaataccgtgcatgggggttaagctgatgttaaaacagtttgcaataaaaaaaaatgaatcagcttaagtcatttaatcatttcaagtgcattctgcatcctttaaaaataagtttaagaaatttaagagaattgtgttttcattaagttttgcatatcttttgttatgccatgtaaattccctttttcgtatgattaaaggaaggttatgataaaatgatta

SEQ ID NO: 16228 - DNA, 2304 bp, Homo sapiens
acgatcgcatatgctgcatttcacgttttattggacattttaccccactgagtggtaaaaaggacagaggctacagatggagttgctttgtttatgaaagtattttggtttgttttctttcatttaattgcctcatatttaaaaaccatgggtccactgttaaaaccacatgtgtatgtgcagctttacattttattttacgtgaagcatgtgattaggaaaactcattttcttttcaagcctcaggacctacctgaagagaagttttcttgtagctcaagttgtgcatgaattactgaatattttactgtgcttttcttcatgaagggtacatgctttgtactcttcactgaaagctgaaaacatttcttgttaccctcttttgtgcctttttattttgccaaccgtgtttatagaaaggacattactaatgacattttgcagattaaaaacattcatttgaacacagtagtcccctagaaaaacaactctacaaaaattttgcagccttattcattataattttgataaaattaacacaaaatcagtcaagaaggaaacatgtatattagtgaagtgtttttggagactgtttgaatgtgaccaaatgtggttctagttgacttcttttcactttggcttatatcaattcttgagagttaatgtgatcatgatattgcaaacaactataaatggtctctaggccttactttgtgattatacgttatctccggctagaaaaaaataatggtagtaaagaaactgacaaactgaaaataagaaaacaaaaatcaaatgcctataataccataatgccagtttggtatagagtccaactttaaaacatgaattgctcgacagagttctattcagtaggtgtttctttgtattgtcttttgtgaatttattatgaaaatgctgcgttgtgttgaatgaaaaagacccaaattactgcttatgaagaaataaagccagcattgatcacttaatcctgtttctcatgtccagccagaaaaaagaacttcagtgaaggtaagataaataaatacatacacatatgtttttttggtagataagtgctaattacatatatgtaatgctttattaaatttctgaaatatttggtaactaaaattttctttttggaaattaataaatccagatacatattaatgttgatatgagtaaaaacaaataggaagaaattgaaatttcttttcatcaacatgtagagctgctattttactatttggagaatatgatgtgaaaattggacctcaaagggtttccttgtgttttcattgtaaaataccatcatcagtgagagtcttgagttcactaacattgtcaccttctggagagagagttaatggggggcattgaggatgatatttttttacatgtgtttggtttctgattcaagtgacacgcacaaactgaaaaaaaaaaaacaaaaaaagcaacaataactttcagggcacctattgctctaaatgcataatataacttgctgccagaaccagatgtgtttaaaaaagaaaataaaaccaccttctttctatagccattaaagcaaactttactgttctaacaaatttgtattttattttgcattgccacacatctgcttatttaaaaactacatccctttggtagtaatgtttcaggacaagtaggtattacagcttgatgtttgtgtgttctaattctaagagttctttattccagatcatatagagtagttaagacaactgtaacagcattttttgaaatacattgtaaaataataaaaggtaacataattaaaatcgagtggatattatatacttgtggtataagcattattgattatttatttttaaattttattttaagttctgggatacatgtgctgaatgtatcataggtatacatgtgccatggtggtttgctgtacctatcaacccgtcatctaggttttaagccccgcatacattaggtatttttcctaatgctctccctccccttcaccccaccccctgatatgccctggtgtgtgatgtttccctatgttgattactcttaagcctgtttgtacacacgttgcctggcacactttcccagttccctgcagttgtgctacctgactaattcccatgcatcttccattcgtttccttcctgacaccacacctgcctctctccagattggattgctgctcctgtgcatatactcattgtagcatctatcacattatatcaaaattgcatatttaacagtgtctctcccctgctaagctctctgagaagagaatcttttttaagt

SEQ ID NO: 16229 - DNA, 2321 bp, Homo sapiens
cctttattaacattactgtcctggggcgtgtgtgtgctaatctattccagagaggcaggcatctcagaaattccagcacctttgaaacttcttaagacattggaaaggaaactttgtactttctctctttactcagagaagtaaaatttaacaaaagcagggtattgccaagatggttgtagttttcatttagaggaagcagtttggctacttctttacctttcattctgttgatatgttctgtgttcataacaacccatcaatttgtaaaggttttaatattcccagtagttgcttggtttttcatgcagaacatacccagccctctaatccatgattgggaggtgggggcgtatcgttactgttacttgaaccaatatctttatttatactttttgtttgtttctagtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaccatagtgcttccattttttcttttttcacaataggtaagattcttttgcacacgtagcttctttagaataattttctttctgcatttttcaagtggaattatattccttaaaataagctcttaaaatcacctctcattcactttttctcatataaagagatctcagcattaaaacaggacagtcatgaggtatcacagttgactcagggttctcaaacccataatctacttctgagattggtgaaatttgtcttcccagcttctcccacacccacgtcattcagtttctagttctttcacccaacacaacacctgaagtaaaag

SEQ ID NO: 16230 - DNA, 1136 bp, Homo sapiens
tacgtccaaaatattgtatcactttaaaatgtcaatataaaaacaattagatgtttttacattcttttggggggtactaagtctttgaaatccagtgtatattgtgtacttacagcacatctcaatttggactagtcatatctcaggcacccaatatccacatgtggctagtggctaccatattggacagtgtgggtatagaggtctgagggtagtagaggaatatggtcagctggtcactctcgtgagatggccataccttggcctatatttaatgtgtacagaaagtctgataactcagatccttaaaaattcaggcccactgtttcagtacatagagagtggaactatcatggcaaacccacattaaccaagctcacagtaactatttttttaaaacactatcaatattttaatttacagtgagaaatgtaactatcaattattctctccctttaggcaaatcttcctgggaagccaaattatgagcagctggtgagcatggattctgagcaagggaagcaagttgcctcgtgcacccatgtccctttgggtgcacagaagacccatgtcttctgtgatattcatgtttgtggaccagggtaccctcttcccctggaaggtgctagagattctctgccagtagttgcttctctacatcagcttctgattggcacatgcattaaataacgtcattacctcaagccttgtttcagttgagcttacctgggctccattctgcctgtatacatgattgcttctgctctgatccattgtttctcttatagtttgaaactgaaaagatcatcctatttccacattctcaggggaactgtgggtgtggctcccatttcctgcctacacatataataaacccattgaaaagttgttttattatgtatatgtgggaatcaccttctatagcccttttgtttttttttttttttgagacagggtctcgctgctaactaggctggagtgcagtggcatgatcactgcagcctccacctcctaggctcaagcaatcctcccacctcagcctcctgagtgccaccacaccacccagctaatttttttttttttttttttttttttttttgagacagagccttgctctgtcgcccaggctggagtgc

SEQ ID NO: 16231 - DNA, 1091 bp, Homo sapiens
gatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcatatttttatctttgacatttaccttataactcaatcttttggaaaacacaatgctaaattacaaggaaatcaaagttagcttcttggctcttgtaattcatccctcagatgtttactcagtccgagcttatctactaatgactcaccttgcaagtgagtaagcagaagcccagttagggctgttggagtcctgactaacacaggggagaggtcagctttgagccaggccttttgttcctacagtggtgaactgcataagacatcagcaagtcttgcaagtactaaaatactagttgtatttatttctatcaatcattggcctttttaaagtgataagaaaaggccactccactctacttgattgatatcagttgtaaacaaggtaccactgtgccattccctatatcttcccaggtccaactcattagaagggatatggtgcaaacttctaaatcaaacacattaacatattattt

SEQ ID NO: 16232 - DNA, 1143 bp, Homo sapiens
tccccaaaaggaagatttttgtttagtagcctagaaagaagaaattgctattctttactcagtacttgcaaatgtataatattgttttgccacaacatgaattaatttaattaatgtatctataggggctaggagaaaattatgacaataatggacaagtataaaagatgggtttcctatatatagggagaaaaaggaattgctataaatgactttttacaacattttaaaaaacaatttagtcccagccacttgctttcttggaagaagatattcgggaagttttaaaagaagaaactggaacagacctattcctcaaagaggaagatgaacctgcttacaaaagctgcaaacaagaggtaatcttctagtattattgttaataaaagtcttattgtatccaagagactttgccataaagcttctacataaattactcattctagaataccgcttctgggaagaaagtcagaaaatcactagtcttagataattgggaaaaagaagaatcaggcactcaactgttgactgaagacatttcagacatgcaggtttgtaaaggattattattgttgttattttaaatggttgctttaagtcctagaggttcttatttcttactcattgtgtagccagttcattagaaattcatggagaatttttatcttagtatcattttgcctaattcacagagaaactattcactgtagagaatattttatttacttttttttatatttcttttgttatgagaggagttagctgccttatatctgatgtcaaaaaatcgtagttctcaagattttaaatatcaaagtttatctttggttcatttccaaaataatattactacattactagaaatttcatcagagccaaatgctttcttggagggaaataaacagggcttccattaccacttactcagtagtccctccatttgtctccatttttgaattagttattttcctctttcttttttctctcttagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaa

SEQ ID NO: 16233 - DNA, 1397 bp, Homo sapiens
aatgtgattcagttgtgttgctgtctgagccacagccaattgtgtgtgctctattaatatgttaccattatttttgattcctggcttggtcaagaacaacctgatttttttttttttaatcttgcagaaaagttgattgcaaagtgtggtagaaaaagaaataatggtagcagtagagaatttataaataagagtttatctttatgaatgagttaattgttctacaattttgatcagtggtatttaagcctgtatatgctaagtgtatttatgcccctttgagccaaaatttttttttttttttcagaatccataagagtttatttgttggcttcacttgggtttagatgcaaattttactgcatcacaccctgatcagctgggtatttgcttagtgtattcatcaaatcttcagtgccagtttccttgagaagcagctttcatgcttattccttaaaaacaacagaagagtgtttatcctgagattggtattgcactattttattttattctgcaaatctgtatcctgaagtgtacatttcaacccatattcttctctgttcactgaaattaagttgaatttgaatggctgaaagacaaaatatatgttaatacaatctcttacctagagcattcaaagcctggctgtctctgtttgcacatgtaacagatgcagaactgtgtttgtaattctaagaaaatgtatgtcagaaagtattttatcagatgtttaaaaatctctgcctgttgattcataagggatatagacagtactttaacttgtgtttccagataaggcagattttggtcatctttctgtgaaagtatctctaactgaatccacttcttaaacaaactactctattttaaataaggaaagaatggagaatctagacattttacaggtgtatctgagcaaaatatatatttgggttagtttttatcacattatcacgtttgtctttatattttatcttcatcctaaattttctccctatcaaaacagcaggaaatttttaaacttttatattgtacactatttttgcataaaataagagctgtagctaccaaatactatttactacttagtaaaggtggcttctgtgtattaaactacgaattacaaatatcacttcactaaccactataattatttttggctttttcagccactggaactttttttggggggatttaaatacaggaaaactgtttaagcaaaaaatgcactgctttcatgtaaaatgatataatcttctttaacaaatattttcttcattgataactgacagatatctcatagcattaacataaaataccagaaacaaactttatctccctattcttacatttagtgcaaattggaatgcgtatgtgaatgttagaagatggactta

SEQ ID NO: 16234 - DNA, 1273 bp, Homo sapiens
gcctggactggaccgagtcgggttggtgggggtctgggctatgagcttttgagggtcgcctgggacgcggagcgagacacgagagccaggagctatgtctcagccgccgccgccgccgcctccgttgccgccgccacctcctccccctgaggctccacagactccgtcgtccttggcgtcggcggctgcttcgggggggcttttgaagcggagagaccggagaatcctttccgggagctgcccggatccgaagtgtcaggcgcgtctatttttcccggcctccggttctgtcagcatcgagtgtaccgagtgcggccagcggcacgagcagcaacagctgctgggggttgaggaggtgaccgacccggacgtagtgctacacaacctgctgcggaacgcgctgctcggggttacgggggcacccaagaagaacacggaactggtaaaggtgatgggcctttccaactatcactgcaaattgttgtcgcccatattagctcgctatggaatggacaaacagacaggccgggccaagcttctccgggacatgaaccagggcgaactgttcgattgcgccttactgggtgaccgcgccttcctcatagaaccagagcatgttaacactgtgggctatggcaaggaccgctccggaagcctcctgtatttgcatgacactctggaggacattaagcgggccaataaaagccaggaatgtctcattccagtgcatgtggacggggatggacactgcttggtgcatgctgtgtctcgggctctagtaggccgagagctcttctggcatgccttaagagagaatcttaaacagcactttcagcagcacctggcccgatatcaagctctgttccatgacttcattgatgctgctgagtgggaggacattatcaatgagtgtgaccctctgtttgtaccacctgagggtgttcccttgggcctgaggaatatccacatatttggtcttgccaatgtgctacatcgtcctattattctgttagattccctcagtggcatgagaagctctggtgattattcagccacctttctacctgggctcatccctgcagagaagtgcactgggaaagatggtcatttgaacaaaccaatctgtattgcatggagcagctccggtagaaaccattatatccccttggtaggcataaaaggggctgctttgcccaaactgcctatgaatttgcttcctaaagcatggggtgtgcctcaggaccttattaaaaagtacataaaacttgaagag

SEQ ID NO: 16235 - DNA, 1101 bp, Homo sapiens
gcctgtaatcccagctactcgggagggtgaggcaggagaattgcttgaacccaggaggcggaggttgcagtgagccaagatcgcgccactggcatgccagcccaggtggcagtgtgagactctgtctcaaataaataaataaataaaggattaaattaatgaaagaaaagctaaggtgaataatactgtgcttttgatgttttaggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaatt

SEQ ID NO: 16236 - DNA, 1101 bp, Homo sapiens; identical to SEQ ID NO: 16235

SEQ ID NO: 16237 - DNA, 1259 bp, Homo sapiens
aatgagttggactacaagagacctgcgcttatgtctcctgcctgccacctgtgttacctgagccacgtgtcccttgcctcctgtagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccatgattattgatttatataatagaattgtatagattatttttgcacagttttgtcataaattagggtggtaatgaactggattgaactactatatgtgcattatattgaattctgcttgtcattaagataaggtgaataagtgtcttaaacgtcctgtaaaaccggactcccctttgttacatgcacattttccattgttacctcgatgcaaaagaattcatttagtaggtacatctattgtagctgtgattattccagtttctgtgtgatgcaatcaaatgtcctattaattaattattatttcatgtcatttgtagctactgatacagcagaaatgaagggaactgtaattacttgtatttttgtaagccatacgttaaatgtttgttacatcatctttctgcttctatttttatgccaatgaaggcatttgtcttgttactaattacatgatgtaactacttcttgatataaataaatttttattttaattactaaaatctttttaactactatggagctttctagactagttttctagaggttgaatagaggtggggacacccgggagtcaaggacagagagactggagtcttcttcttccaccatggaaccttggataagtgagtccatgtgagttttctaatcactcagtaagtgatacttctaaaaaaggaaagagtcattcaaataattgtgacattctgactcagattagaatctcagaaccatgacagctgagaacatccccaggcactgcttctctctctaataatacttcctctgatgta

SEQ ID NO: 16238 - DNA, 1752 bp, Homo sapiens
agatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatcaaaacctgtataacccacccccatgtttcattgattctggtctattaaggctgaacaactatggaaaagacattttcagccagaactacaaattcaatattgtttggttctggtattttctttccagcttctagcattagatcctccttacactgtacttaccataggatacttatttttaaggcaatttttaaaatttttatttatcttttagagaccggatctcactctgttgtccaggctggagtgcagtggtatgagcacagctcactgtagcctcaaactgggctcacgattctcacactccaccctccccagtagtgaggactgtaggcacacaccactacacttgcctaattaaaaaaaaattttttttttttagagatgggatctcactatattgcccaggctggtctcaaactcttggacctga

SEQ ID NO: 16239 - DNA, 1179 bp, Homo sapiens
gttttagctacttgagaagtgaaaacttgagctggttggccaggagtgtggcctaggccaaggtctgccaagggctgggctagcaccgagcccgctggtttagagagaaaccagtctgctttctccagtcacacatgatgacatggccattttgccagccagttactaaaaagaagaggaggggttgtgaaagagaataattaaaatgatgcatggactccatagcagttgagaagagaagggaggacttgaggggctgaggaacgcagggccagggagttgggagtccaggagggtctggactaatgggaggtggtgcttggggacgaggatgcgtactggaaggtggaccttcccttactttctgttaggttagatcaagctgagtatctgtggctttcttgtaaaactggtctttggggagcattgagttgtaaatcaagtaaaattattgtgactgtgtgtatatgctggggtggtttgttttccaaagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggtaagctgcacacgcctcacatttaatgtttactgttgatggatgtgggacaggtacatacaggtctcagaactcattgactgtctgctataggtctgtgcatgtcactatatgtactctgaccttaacagtaataaagtaacctcacaacgaggcccttttctggtctacagtaagccagataactgcttgggtggattttttcccccttggtctattatttgacttacattgttctttcatcttgtttacccaacctggaccttcttgttgatactcattggcatgacaaaagctgtcttttcattaggaaataaatatgtgtaaaagtcgcacacacaaaacctggcatgtgtatttgaatggcttctctgtttactgggagtggccagagctcagagtgaaggtgaatttattgggatgtgaggtatatttgttctagaacaagttagacattttaaacaaaaaataagcttttattataaaccaaagtgacattgttaattttttaatttaa

SEQ ID NO: 16240 - DNA, 1176 bp, Homo sapiens
tttaactactttttaaatattgtccaactggaaaccagaaatatcactgatgtctcaatgtaaaatatttaactattttttaaaaattaggctaaatgatgttcagggaatgggcttaaagaaaagataataatgttgtttgttgcaagtaggaaaatgattaacaggatcttactggaaatagtgtgaaatattgcaagagacaaagcttacaaagagagaggagttctgaagtcgggtaaaactaatatttttatgaatattgattatttccatttttaaattgatgtgaataatttataggtacagttcttaaaatatgcctaaggtcctctattgaatgtattattttgctctcccatttattcaagcccaggcagcattatatagttttccccctttgtttaagaaagctttctagataactgccaagaatttcatttctttttttcagaacttgtattgtctaaaagatttgagaaattttaatgtgttatcataatctttaattaaaatacaatttttaatttttgtagttggcttggacgccttttctggctgcattcagtgtgggtctacaagattgtgatgatactgaagtagcctctctttgcctggaaggtataagatgtgcaatcagaattgcatgcattttcagcattcaggtaacagagaattttgtctttgtagccagtttggaacattaattacctatgccattacaatagtttaaattacaataattgtttatgtgtgacattaaaaactaatttcaagtttatgatggaatttaaatgaatcttaatgtttaagcttctgagaagctgttatagaaggggtagttctatactgatctgtctaagtttatcattataactttggttacagttttttttctctattgaagactatacagaaagttttcaagactttgaattcctatgttaatttgaacatcttgtttaaacgaataaaatatcttgttgaatcatagtttatatacaaggttgtatatattttatatgatttcataacttaagcctaagaacaggttatctttaagacatgtaaatattgaatacataattttcatgaaagaagtcctttctagtaatttatatgctttgaggaacttttaaaaaaagaaaaattcattcaacatttaattataaatgc

SEQ ID NO: 16241 - DNA, 1109 bp, Homo sapiens
cacccagctaattttttattttttgtagagatgggctttccctgtgttgccagctggcctcgaactcctaagctcaagcagtccacccaatgtggactgacaatgtgggaggcaagcaggcctcccaaagtgctgggattacaggcatgagccactgcgcccagcacagtaagcaattctaactcatcagagacaggttctccaaggcctgactttctcaaaatattacctgatggttttattgtggttattgttctgtttttgtgattattacaagtataaataactttgcatatttgaataaagtttctacagaaaaagttggtatagctttggctttgataatacctttatgtttttgtgtaaaaattttatgtatattcaattgtatactgtaattttaatgtatattgcattagtatgtataatatttgttaccttacttaggatctttgttttctttctccattttagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggtaattattatataaagtaaaattgttattaataatctgtatcttcaaaattcagatgcctttcaccttaaaacattaggaaagatcattttatgtgcattccagctataatacaggttattcgaggccgggctcagtggctcatgcctgtaatcccagcactttgggaggccaagttgggcggatcacttgaggtcaggagtttgagagcagcctggccaacatggtgaaacccccatctctactaaaaatactctactaaaaataccaaaaaaattagctgggcatgatggtgggcacctgtagttccagccactcaggaggctgaggcaggagaatcacttgaacctgggaggcggaggttgcagtgagccaagaccatgccactgtgctccagcctgggtgacagagtgaaactcagtctcaagaaaaaaacgaagaggtcatttggatgctttctagactccatattaggggattttaatgtt

SEQ ID NO: 16242 - DNA, 1492 bp, Homo sapiens
tacattcaaatactttcaaatttgtcattcacccagcaaccttataagtagtaatgattttatcatacaactatttctacacttgacagatgagggagcaagactcagagggactcactcacatgctcttctggttgcaaagttgatttgagtggggccaggagtgaaacccaaatcccctggctgaaaggaccgtgccattttcagcactaaccatgcttagtcatagatgttttcacgaatgtgatcttttttttccccaattttctgttgtttaatcacctgtaacctaaggccactctgtgataacaaatgactaggggaaaatgcttttgagtgtcatacttctcattgattaactctgtaaaaacaatgtaagttgcttgtccaggtaagtagaaagccttttctccactaatgattcaccttcttctctcttttcacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggtt

SEQ ID NO: 16243 - DNA, 1100 bp, Homo sapiens
gcagtgagccgagatcacacccctgcactccagcctgggtgacagagcaagactccatctcaaaaaaaaaaaaagaaaagaaaagaaaattctcttgaccaggcacagtggctcacgcatgtaatcctagcactttgggaggccaagaggggctgatcacctgaggtcaggagttctagaccagcctggccaacatgatgaaaccctgtttctactaaaaatacaaaaattagccaggcgtggtagtgggcacctgtaatcccagctacttgggaggctgaggcaggagaatcgcttgaacctgggaggcagaggttgcagtgagccaagatcgtgccactgcactacagactgggcaatacagcaagattctgtctcaaaaaaagaaaattcctcttgaagtagccaaagaattcttggctaaaaataaataaataaataaatatcctcttgaaggaactagggagggaagtaactgaagagacattgtgtttgctgtgtttgacagagtctgcagaaggctacagatgtgaaagatgtgggaaggtatttacctacaaatattacagagataagcacctcaagtacaccccctgtgtggacaagggcgataggaaatttccctgttctctctgcaaacgatcctttgagaagcgggaccggcttcggatccacattcttcatgttcatgagaagcaccggcctcacaaggtgagtattaggaggacacatgacccaccatcacgttctctctcccttcccaagctcctgaacacggggagttgccttgtaggtgctagctgcagggctgtgatgcctgacggacaccctctctgaaggaggagaggatagtattacggaacaggcaggcgtgaataggcacagcgatgcacatgtgttaggatgcaggtacccacagagggaggaacatggaggaaggagtgtccacggccacctggacacgtggattatgaaagatgcacagaggtggccttgagccaagtatagaaggacaaatggggtgtctgatttatactggtggcagggttagttgggcaggaaagagtcgagctgttccagacaggagagagcctggcatg

SEQ ID NO: 16244 - DNA, 1183 bp, Homo sapiens
atgcaatgacagccttcagcagttcacacctaacagtcccagctcagctagctacgctgaccttagtcaggcattacctctgatcctcaaattccttgaatttgcctaatggggttaattacataaacttccatgaggctgttctgagtctcaaatgagaaattgtatatggaattgtttacagtgaaatcgtgtatgaacagaccatgtaaaatgagcagggaaaaatagaaacaacaaataaatatcaaactgggatgatggttacctttagggaattaaggagggaaacacctcataaaagcactttataatgcatttttaatgaaaaattgttttaacctgccttttgctaggatctgattctcttcctcaaactctggataaagactcccttcaacttccagaaggtaggcaggactccttgcatggatttctttccctgaactaatgcagagtcaactctcctcattctcttttcctgcctcggctttcccctaggtctatgcctcatgcagacggtgtttggtgaagtcccacattttggtgtgttctgcagtagttttatcgccaaaggagtcaggtttgggccctttcaaggtaaagtggtcaatgccagtgaagtgaagacctacggagacaattctgtgatgtgggaggtaaatctgtttctggtgggtctgctgctgaaaatggggcgggagactagtccggggaaatcttggcctttgcccttttgggagagtcctggtcagagagagaggacatccagggcagatatctgtggtttgtgttgcctgtaaaaggaaggaacggccagtgtttgctccatgaggatagcacctctgcatgaattctgtgttttgtgggtgccttaagtcattttagtctggaagattagcaatggaatatacatttaaagaatcaatatgttgtattatatttatagacaaaactaaatgctttagatattatagagtgctgaaactatgctaaagagaataaaaacaagttttaaaattcaatattattcacctataaaattagtcaaggattaaaaaaaaaataaccagatactcttcaagatctagtgatgatatattagggatatgctagtgggactgcagtttattacctgcaggagaaaatttgtcagaatgtatcagataccttaaaatgttca

SEQ ID NO: 16245 - DNA, 1245 bp, Homo sapiens
tgacagctgcggcggcgcgggaggcccatcctcggtcgtttaaagccacttaaggaataaaagcccccgagagagcaaaacgaccacccgaaacctcggaagcgtcgggggtgccgggcccaacgctcccacgtgtcactgccggggactcgcgaggcgaagcttcccagcgctcaaggcgctcccgcctcgtccccaggtatcaggaacagacacccaccaggtccaccagcgggtcagacgccgccttcgggcaggctgggatcttccgaactgggagcggagagtaaggggctcgaccccgggacgcgagtccggccttctggactccggttcagggtgtgtgtgcgcgcggaggggcttatctgggggccctgggtagcacacgtgttcggtttttttctccccgactccgcacgcctggagcggcaatactgcctgccctagaaggccagcggcgagtgctcgccactagggtcccagggagggtttggaaaactgatgagttaagtgagcgaccccaggggacagagggcgagtcgagagtcggccaatggctgcggtgggcggggagaagacgacgcggggatctgcgtgggccgggtcaattccctaccctcgacctgtcgatgccccgcggccccgcccgccctcttaagcctggctcagccctcagggcccgcccgaagtctaccgagcccgagtggcctaccgagcccgagtggccccgcagcgtccaggaggcgcccgctccgcggtggcgctcttggaggtggtgtcggaggtaggcacgggacaggacgcgcctggggcccggggcggtggtcttccagggccgttggggagggcggcagcactcgctggcgcagttcgttttggatggtcgttctgccctctcgggggctttgaatcccaagttgcagatccctgaggtcggaggaggctaggagaagggcgcctttggaggatcgggaggagacgggccgctgcctgtgtcgtggctgacctcttctcctgaccccgtgttctttaatttctgagtcatgaccctgcttggttttcttattgggctcattgatctcaagacccgccggccctgaaggggcttcattcttcagcctcggtgaacttgctgcctgtctattaaaacgccatcctttcccggcggtgcgggggcgggaggactggcagtcgccgaggctcttcgctcccacctggccagggctcgtccacgcggctcccgag

SEQ ID NO: 16246 - DNA, 2762 bp, Homo sapiens
aagcgttgtgtggagggaggaatggcgccctctgcctgttcacctccacatcgaatgtactcatccagatgcggcctctgtgatttgctttattgaaaacagtcaggaattttgatgtttttgtggtgggctttatgatgtttttttcaaaacctcaaagatgtttcacaactttttatctgttttcctacagaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagtta

SEQ ID NO: 16247 - DNA, 2421 bp, Homo sapiens
atccccaaggacttcgctgtcaaatgtgaaaagtttctttatttctacagaaggtatttctcttgaatactatttttaaattcttgtgactttatagttttctgtgctgtcacttttttctgcttttaatagtagttttcttttaatttgctactttcagttcattgtgttaaaaatgttaccaggttttgtgattggttaaatactggtaagtaaatttcacctgagtgaattggattttacattttcttttctgaaggtatctttacatataaagattataacttgcatttatttataaaagagagtaacatggattcttttctttttgcagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatcgttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatctctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttcacaagttgtatcctggatgtttctgtcattgttggtgtttaggctattttggtatataacctcattaaaatgtaccatatttaaaacacttcatagacattcagaataacccttttcaaaattgtgttctgcaaataaacagatttgttccacagaatattggtgaggactactggggggatagatggtcataaccaaataaatctgggaatcactggattaaactaacctaaaggtgtctctttattatgggaccgttcagtccttaatatgcaaacgtgtttcctggtgcaccaagaatgttggatataatatgcagtgtttcccaccttatttgcctgtagaattttctgttcactgaattactatagcactttgttttctgcagcatacactgtgtttaggcaaagaaaaaaaaaagcccttgacatgtcattaccaagggctaatatatacacagaagcacatatacacacaagtatgattataaattatgagccctacatcctgctctcaaatgtgctgag

SEQ ID NO: 16248 - DNA, 1791 bp, Homo sapiens
ataatacagctgcctaagcttaggtgaactgctttttgaatcttagtttgctccttcataaaattggattaatataataccaatttggcagagttttcaaaaaaaatgatgccacatcctgtgtttccaaacagccttacctttcaaaactctttttggaagctgtaaagataatcaagtgatacctgccattatgtaaaggaattttggaatccgtctttggggaaataaaagccataagagagaatgaaagctaatactttgtagtttaaggatttttttccttgatgtatctaattggaaggccgaaagagtcttgtcttttcttttttttgcctgcttcttctgagacatcaaaaaacatcttgatttctgcggagtagatgagatggagaaagatgagacaggcaacagaaatcttaagaggccacaggttaagatggggtactaagcagggagagcaccaaaggaagtaggccaaagtattaatagaagatcctagaacagattaaggcaaatcatttacctgttttccattgccttactatctttctggagccaattacaaactttcctgttttattttaggtctcacaagaatcttttcttatctaagttgcaacatggaacccagcaacaagaccttaataagaaagaaagaagagtaggaactcctcaaagtgagtactgttataacagttttagaaggggagaattgatgtgtcctcaaacaatccagccattgactttaccactatagcaaaaaaacacacacttcagaaaactgaagcacaaagtcttgacttcatagagttaattgagatagtgtttaatttagaaagttagctattttgactgtctagcttagggttcttttgctatggtggtacactgcttttctaccttcactgtgttcagcaacttcaagtatagtcatatgccacatcatgacatttcagtcaaagacagactgcattgcatataggatggtggtcctgtaataatgtaatggagcacatatggaaacttgataatgtggcacttgatattggcattgcatatcaagtaggggaaatgattgataattagcaatggtactgggaaccgtgggttttctatatgaatatatatatatatatgtatgtttgtgtaagtgtactcttaataatgttcacataaggacaaaatcacccaacgccccatttctcagaacatatcccccttgtaaagcaatccgtgactgtagttacttttcagaaacattaagtacagttgattcttgttattcacagtagttacgtttaataaagtctgagagcgttgacttagcaaattacaagtttctttttggtatgtagtcatttaacaaatgtttattgaccccacagtaatattttaggtactgaactgatactgagattttttttttttatactttaagttttagggtacatgttcacaacgtgcaggtttgttacatatgtatacatgtgccatgttggtgtgctgcacccattaactcgtcatttagcattaggtatatctcctaatgctatccctcccccctcccccctgagatttttaatatggatctaaacctaaatacttattgataaaaataatagacataatgaaattaggtttatttctccatgctcataaggtaccatcttggtgccaggcaaatgataggcctgcagtaaatattatagaataaatttgttcatacctgatggctgatgacatggcaaccattagcaaatatttgtaaatagagttctaaaatattta

SEQ ID NO: 16249 - DNA, 1145 bp, Homo sapiens
aagctgaataacgtatatggcaagtttttgaaagaacagaaatgcttaacttggagaccatggagttgataggctctttaaagagagtttatgtggcccccaaatttgtatatgaaattttagatactatacttttctgtggagtacgtctgtaagatttatatgaccccaaagattaataacccactgttgaagtgcttttaatcagtcaccccacacatgaaaaatttattaatgcatctcttggtttttgtcagttaatgacaagcagtgtagtgaggttttgtaggagtgaaggccgagtcaggcagtaatagatggtcataggaggctgtcagcctttgtctagcgattgaatagccatgtacttgtaagcagcacagttgccgataggtgtgctgcagacaaacaaaagcaaaagcacgtacagaagagaccaggttcgtatcttggatttaagtcacaaagcagaggaatagcaagaacaggggatcaggtttaaggtagctcaaacaaacttctgcatgggtttggttacggtcactgccaactttttggtactgagtcatacacgagatggttctcatgtcatgtttgtattcttcaggccaccttgaattctttctaatattgcattagacaattgaactggatttttttttcttcgattatagtaaagtacacatgatataaaatttaccatttgccattttaactatttttaagtgtacagtttggtagcattaaatatattcatattgtgctaccatcactaccatctatcaatagcactcttcctcttacaaaactgaaaccgtactccttaaacagtaagtccatttccatcctcccagcccccttgccaccatcattctactttctgtttatgagttggactattctaggcacctcatatcagaagtagcatagtatttttctttttctgtctaacctaatgtcctcaaggtttatccatgttctagaatgcgtcagaacttcctttttaaggctgaattatataagtataatatataatataattttgtttatccatttatcagttgatggacagttgggttgcatccacattttaactattgtgaataatgctgctatgaacatggatgtacaaatacctcttcagg

SEQ ID NO: 16250 - DNA, 1680 bp, Homo sapiens
tgtgagctttttgagctattgataacatttttgtttattaacgttagagagaagaagaaggaggttcctgctgtgccagaaacccttaagaaaaagcgaaggaatttcgcagagctgaagatcaagcgcctgagaaagaagtttgcccaaaagatggtaagtaaactttttgaggcactagcacataaggaggcgccttattgggattgaggatgaggtgaatgttcttggcaagatttacttcctaactgtactgagtaattgcttagctacctaatgttacaatctgaaggtagtggggttttttggtgggggatgtaattgcatactgtggcaagaaaagatttaaaggaaacatgttgtagttttctttttaatgattggcattgctaattgtgattgagctaaaaattatgaataactgattattggttttcagcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagagggtaagttcagttttactgcattcgggtttgaatgggaaaaaaaaaaaaaaccttcacattacttctgggagccctgattctgaaacaccggagtaacaatattttaggggaagctagaacaaggagggtgctgatcactaatggtttagttgcaagccatgttccccaagctcctatcccttctcttaatagaatacagaaattcagtgtgtaacatgagaggattcctatctgtttaggtaggattcgatattcaaaactataatggttagtattaataaaaatttcgatgaaaggcaaatgcatttctggtccgttttcaccacagtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaagtctcttttctcctttgatttctatttgataaattggttatgtagcaacatgaattttagatgttttaacagtggtcaccttatttatgtttgctttttcacttcaggtaccccaatctgaagtcagtaaatgaactaatctacaagcgtggttatggcaaaatcaataagaagcgaattgctttgacagataacgctttgattgctcgatctcttggtaggttctatttgggggaaaatttggtattagaccatgcgataatttcttaccctcttgtggccgtacatttctcactattgtgaatcttcatgtgttccctatgattcttgatttagcttaaaagaaaacgtaagacatggtttcattagcttgaaccttatctttgtaaagccatgcatttaccttgtttattcctggttatgttttcatctcacagcctattcaaaaagattttgaataattatttcaaaactttttgcaactttaataatcttaaataaccttaaaatatttaggtaaatacggcatcatctgcatggaggatttgattcatgagatctatactgttggaaaacgcttcaaagaggcaaataacttcctgtg

SEQ ID NO: 16251 - DNA, 1188 bp, Homo sapiens
tactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattg

SEQ ID NO: 16252 - DNA, 1194 bp, Homo sapiens
tgcctgtaatcccagcactttgggaggctgaggtgggtggatcatgaggtcaggagtttgagaccagcctgaccaacatggtgaaaccccgtctctactaaaaatacaaaaattagccggtcgtggtgctgcacacctgtaatcccagctactcaggaggctgaggcaggaaaatcgcttgaacctgggaggtggaggttgcagtgagctgagatcccgccattgcacttcagcctgggtgacagagcgcgactctgtctcaaacaaacaaacaaaaagacaccaatcatattggattgccaccctaatgacctcttttaattacctctttaaagaacttatctctaaatacagccacattctgtggtacaaggggttaagacttcaacatatgaatttggaggacacaattcagccaataacatacataattcttttgttttacaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattg

SEQ ID NO: 16253 - DNA, 1250 bp, Homo sapiens
tgcctgtaatcccagctactagggaggctgaggcaggagagtcgcttgaatctgggagacggaagttgcagtgagccaagatcgcgccattgcactccagcctgggcaacaagagcaagactccgtctcagaaaaaaaaaaaaaaaaaaaaaaaaagtaaagaaacaaggccggcccagagcagcttgagcagccgcagtctgcaccctctcccgcccgcccgccctccacggcacccccacccgccccggggtctctttcccccttcctcctcctcctcctccaccccaccttcctcctccgcccgcccgcggggccccccctcaccttcccgcctgcccctattgttccgcccccggcctcccgcccttccccttccagcccattccccttttcccctcagtcgcctcgcgccagcagtttttggctttcaccccccatcagtgaccaaagacttgaccactcaaagtccagctccccagaacactgctcgacatggaaaccagtgtgattgaaggtggattaaatatcactctcaccatccgactacttatgcatggaaaggaagttggcagtatcatcggaaagaaaggagaatcagttaagaagatgcgcgaggagagtggtgcacctatcaacatctcagaagggaattgtcctgagagaattatcacttttgctggacctgctaatgccgtcttcaaaggctttgctatgatcattgacaaactggaagaggacataagcagctctatgaccagtagcacagctgccactagacccccagtcaccctgaggctggtggtccctgctagtcagtgtggctctctcattggaaaaggtggttgcaagatcaaggaaatacgagagagtacaggggctcaggtctagatggcaggggatatgctacccaactcaactgagcaggccatcactattgctggcatcccacaatccatcattgagtgtgtcaaacagatctgtgtggtcatgttggagtcccccccgaagggcgtgaccatcccgtaccagctcaagccttccagctctccggtcatctttgcaggcggtcaggcctatacccttcaaggacagtttgccattccacagccagatttgaccatgctgcaccagttggcaatgcaacagtctcattttcccatgacgcatggcaacactggattcagtgcaggtttggatacatctgctcagactacttctcatgaacttaccattccaaacgatttgat

SEQ ID NO: 16254 - DNA, 1218 bp, Homo sapiens
gccttcttcaagaagggagatgtggtcattgtgctgaccgggtggcaccctggctccggcttcaccaacaccatgtgtgttgttcctgtgccgtgatggaccccagagcccctcctccagctcctgtcccacccccttcccccaacccatccattaggccagcaacgcttgtagagctcactgtgggctgtaatgtggcactggtgggctgggacaccagggaagaagatcaatgcctcgctgaaacatggctgtgtttacagcctgctccagtgggacagcccagagcctggctgcccatcatgtggccccacccaatcaagggaagaaggaggaatgctggactggaggccccaggagccagatggcaagagggtgacagcttcctttcttgtgtttactctgttcagttcctttagaaaatggatgcccagaggactcccaactctggcctggggtcaggaaacagccagcgagagttaggggccttagggcacagggcagttgctccactgaagcagactctggccctggcccttacttgcttcctcaaccccctgggcctccccagtccgcagctgtccccgccctccactcagctgtcctgcagaaaacactccaccctccaccttccattttcccctactactgcagagcctccaggcctgctgctatagagcctacctgtatgtcaataaacaacagttgaagcgcgtgcacacacacacacacacacacacacacagtacaaacatgagccgggcatggtggtggacacctgtaatcccagctactcgggaggctgaggcaggagaattgcttgaccccgggaggtggaggttgcagtgagctgagattgcgccattgcactccagcctgggcaacagaaccagactctgtctcaaaaataaattaaataaataaataaataaataaattcctcaccaatatttttttccattccttttttttcctcttcctgggatttcaattacatgtatattagaccacttcataaaatcttacaggtactgattttttgctcatttttttcaccctttttttctttttctgcttcaatttggataattactatgactctattttaatttcatttatcattctgtagtattcaatcttttattaaacccaatgaatagatgtttgatttcagactatctataatgtatgcaaattttgctctcagaatttccactt

SEQ ID NO: 16255 - DNA, 1173 bp, Homo sapiens
gttaatttttttcccctcagttatctttattcagtcttattggtcaaaacaaagaaacaaatagtccatcaactaaaataagctgtaatgaatttagaagatgaatgcatatattagatttccatttaaatcacttctgttataaatcatataaagaactttaaacttgttttatctaatactgagcactgtttttttgtcaagtatttttttaagaccacataattctttttgtctgctcaaggaaaggatagataaataattggcacacatttgtttctcactgaattttacagtagtaaattaatgttataatgtaccacatggagatgagttggtaagaaatcatctagttccagagcccagagattataaacagtaggtgaaatagatttatgacttacgaaatatgttgtgacaatatatttaaatgcatttttatattacttgcatattctcacattgatttgtgcaatagttcagttttaaaaaaaatcttcctatgcatcatgtattttatttttatttattttcacaagtatttgacagtatggtagaataaaagatgattgtaagattaaaaatgtaaaaattgcttatgtattattctgaattgtgttaggttgaaaaagatgattgtggtgactattatttcttgtccactatttgttttttgttttttcaccaataatgtcttcatatttgaacctattcaataaagacatgaagcataaaaatgctagttcgtattcactgatgtcttttagccatacatagaaagataggaacctaatgaaatataaataaaatatttgaagtcaaaaataacagatttttacaaataaaaagtagcttttcattggctgtattcttatgccatcagctttttaaaatgtattaccattttattgaagtgttttctgacatcaaagtattagaaatgtttttgttacaagttttttaaggcattatcttcatagactatttagcagtcacaaacatttgtgatgtcaaggttaataggaaacatggacgtttctagttaagagctatacagtttaatggcaaagttatttgtgatgaataatattttagaccacatttaaaattaaaaaggaatttagtgaaatttcagattagacatgtttgatttttttccttaggttagaggtg

SEQ ID NO: 16256 - DNA, 1774 bp, Homo sapiens
aagcgcatggtacgcaaaggaccagacaaaaagggcctgtgacatttcttcttccttttgtgttttttaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgttctcttgcctcttcatgtgtctgaccctggagttcagattttaaaagggcagccactgaattagacaatctcacaagcaaagagataataaggagagtttgaaggaaaccagtgccctgctgagtcatttccctttgggaacagcaggccgcatctcttttctcttgccctctgatgggccaacactgtgggagaggtcttcaatctgctccctttaaaaacatacaggactgaacaagataccacaaaatgcagactgataattctgaggaagtgagcccttttcaaaacattgaaggttcctggcattatctcaagttctcccctgtggcccacagaacgcc

SEQ ID NO: 16257 - DNA, 2526 bp, Homo sapiens
tctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatca

SEQ ID NO: 16258 - DNA, 1110 bp, Homo sapiens
tttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattg

SEQ ID NO: 16259 - DNA, 1164 bp, Homo sapiens
ttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggtacactacgggattgttgtgcttttgtttggttttagttggaaataaggtttgatgtagatggcttgttactgttaatttaaaatattctataattgtccattactttatgttgtgttgtgacagatttggctatatttttagtcaattgaaatatgatactttaaaagtttgtttttaggtaatccaaaggaaaagtgtttatactcttgaatatattagcctcagcctatataaaaatttctttgaagtaaacattttaccggaaacagaattgacagatttttctacttgctgactgcctaacttattttgtttcatgatctcgagggactgccttttcccatctagatcttttaaaaaaatagttttagtactaaggtatactactggacatttctatttttttaagtgtattctttttctgacttacagtaaaatttcagga

SEQ ID NO: 16260 - DNA, 1073 bp, Homo sapiens
actggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagtttttttttttttcctgctgtatctctgctttcaactgaagttaaagaattctagatagtttaaaatgtgttagggataagcacacttcaaaagatgttttctagccctaaattttatgacattgggtacttaaatttggagtacactagctattgagaacaatattttgggttgaggagagatggttgaggccattatttagtgggagcattggcattttgaacactgtaaacaaaagaacacttccgcctgctgtttgtaaaagctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcactaaactgcttctggctttgtgaattttattgactgacatttaattcagatttctttgcaagtgtactaatttagactaattggggtaaggggaacaccttaatgaactttgacttatgtataattcagatatctttgtacttaaggcttacaagtttgaattatggaatactataagggttttttgtttatttgtatgtttttatatgaaagtacataaatgacagactacctccaagtaatcctgctttaattaatagcagtgatttgtaatcagtgtatcttttaagattctctacaggttttagaaaatattaaaaattccctgtaatttacatttgtgcataatcttggaaatgggttgaaaagcaaaggtaaactgcttcatcccatgttgtatatttgtggactgattgactacaagtgatgtgatgttataaatttgaagtctttgaaactttattaatg

SEQ ID NO: 16261 - DNA, 3406 bp, Homo sapiens
tgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgcttctattcggagaccaatttatttaattaaggataactataccaagaaagtctcgctggggcttggggttttacctagagttgtaaaaatagttcaaaaccaaggagatgtcttcatcatcaaggccatttttagaaacatgtggaaggcatgtgtcctcaggttcagccctgctaatgacaatttcaacccattcccttagcaatgattgtccaaatatgttagctgctgaccctgtgctgctgactgttgtcccaagcaagtaggcaatgtggcaaacagagggaaaataatacctattttgaagctaagccagcctggaattgtcatcctcaggc

SEQ ID NO: 16262 - DNA, 1213 bp, Homo sapiens
acactatttcatttgatctttgtaagaacccagtgtagaataggaatatttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaataactaccaacttctaaagagaagatccccttgatttatttatatcatgaaaatactaaaaatcaattctcaagtctaattaactattacattatcttgctaggtccttttccctaa

SEQ ID NO: 16263 - DNA, 2149 bp, Homo sapiens
ttattttgttatattttggaactaaatgaagtgccaaattaaccagacattcgtttgatgccatctctgtggaaccaagttctctgtgtgtgttcgtttggctgggaggagggggaggactgggcagactgctcccacagcaggctggcagtggaactggagccctggccaccgcagggagctcagaggccaatctacgcaaaaggcatgcaaaacaatggattctggtcccaaaatatttctaagtaaggcatgatgtagccttttgattttttttttatcctttgacaccccagccttcagaaaaggtttttcatctctctccaaagaagtcatttcatagtgactgacaggacattctccagagagcgacaaagcagagtggccagcaggcagtggtgttaagccttgggccttcccagcagatgtgtgctgcattggtgggtgggaggcagtgtgacagcctggagaaaacacacaggtagcaagggagtcaggggggaggtacaagagggctgtggacacctggctcttgctcatcttcttggtgctgatcagctggtggtcaccatccctaagtacctcccagggagctgccattttctcctctgggagcagctgcctgaagcaaggagagaatgacctgaagggaagtacctccggccaagagtgcagggctgctgtgcctagcctgagcgggccatctctagcagatatggacttctctccaccacactagctgaaaagttttctcccttggttggcaaaagccagtgtcaggaaaaaagctgtgggtttctgaccaagaatgtgtgcgcttagctgcaaagtgcctgtcagcagctccaggcaccaacaaggtgcccttttattagacaattcctgcccgaacataaccatattgcagatgaaaattttcaatagagaatgacacaattcttgacctttctaaaaacttttcaaagagatagtcacatgtgtatatgttgcaaaagatttttgaaactgaaatgtcctccattaaatctcaagagcactcgagttttaagtctgctgtttctggtgtcacactaagacacacttttgaaagcagccctgggttctgaattagttggcactgctgaatccatgttcccccttcatcagactccaaagtgcagcattcacttgcaaaggttgagagaaaagtggccagaattgtacatataacagagaataccttgagaatagtagcaaaatactgtaaataatattcatttcctcagggaaaaataaagggcatgcaaaaataggtctggagactcctgaaactaggaagaattttgttatcactaaagtcttttatagtcagaacaatttttttttcaaatgaacatggtatcatttcaagacaaatttatgtgaactgggcagtactgacatttgtgaggcataggggagtgccctgggaaaacggtttggagctgacctgtagcctaaggctaacatttgaaccacaggtgcaatgcctgggggtgggggagggggacggggtgggggtggtattcctagactcacgtaaggctttttctgaatgtaattgtgaatacaaagccttgctggtcctttttatcattacccaatggatgactgtttattagctatcagcagaattccgtaggcgaaagcaagccgtgaacgatgtacattttgctttaatagcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaa

SEQ ID NO: 16264 - DNA, 1240 bp, Homo sapiens
tttgagttattaaacattgccatgcatccacaagagctgtattgtggcctgtagagaaacatagcatagtaatcaagagtgcaggctttgggcccacagctctgacctgaggcaaattccctacctctctggccctcagtttcctaatttgtaaagtgtgtatatgtgtggaggtggcaatgactactttgtagggttataatttggattaaattagataaaatatataaaacatttagcatagtttctagcataaaacaagagctaaataaatgataatgattactatattatttaatattattgctgtggtgttttttatactcttgagctaaaaaattttgaagaatcacacagactgtaactcatgcccttgtaattggaccctatttttgaagaatgctggttacctttgtagtttggtaagtgcagcaatcagtgacttatttactgataagctctgctttcctcttgctcaggagctgatactaatgcaggcaatgtgttatgtttcccacgacacccttgaataaaatgccatttcctcaggaacagctagaaataccgatgctaatttttcctatgctcaggaaaagcaagagctctcctgctgcagtgggctggaaggagctctccagaaatattatgtcatcctaatttgcactgccaagggatgagctcatcggggcggggtctcatgaggctgcagctgtgccagttcctcacttgtatgatgtgcgtcctccaagctcgcctctccctcgttacccgctccatccaccccctgcctgcctgcgccaaacaagagccactgcatgatgaattatttaaaacccgaaggcgaactcttgcaaaatataaccaggcatcagaaggcacaaaaaaagcaaactgtgcgttttggttattttgtattatttttaaaaacgaaaaaaaaaaacaaaaacaaaaaccagttgcagaactgctgttgtcactgagaagagacttctgttgtttcttttgcatctccttctttgtctgagagcagaatctttcccctcttccacttaaaacaacaacttgatctatgactgaaccgatgctgggtctgagccgatcgtaagtctggccctgagccacatggctatagcaagggagaaatgtgtgcgatttcccacattcttttcattataatatgtattgtgagtatctttatttaatctcttgctattctacctggcagtataggttgtggtta

SEQ ID NO: 16265 - DNA, 1129 bp, Homo sapiens
aacttagctgcataattgccacagccctaccaaccaaaactgcagaatttctccctgtgcttgggaattccgtgaaatttctctatcttgactatctataaagcttaatatagccaacgataacattgcagaagtagggactgccatcaaaaatacaatgtgacatggctttaaaattccataggagcccaaaaagaagtaaaactatttagctcctgaattatgaatttggaaatttgaaatgtttatatcaaatatattgagacactgatacctatatttacagcgaaactaaggaaaaagaatgctgcaggaggttgtaggaatagaagaaatgggtgtcctcttaaagcacacagtttttattctaaacttaaacattttaaaagttgatcattcaaattgtaaatgtttttcttaattattgaccacagattttttaaagtacagtttttaatgcatacaagtgtcatttctgtttgttttgtattactttcattttctcatagcaatttactactacaagggaataagtaaaaatttaggtacttatgagctttgaggatcagtaaaaaataaagatatatctgtttgtcttctagtttaaaccacataattagctacttgaatgtttaatattggttagttcatgtgtgtctcctcattacttctggcctccccaatggtaaaagggatggtccattagttaagcacattattttgagcaaagatcacccgttccctggctctgtgcataaataaaagcgtatttgtgccagttgagtgcccttgtgaattgtgatgaagatgtcatgcactaatttgcagccagattagattatgacaaacttagcagggatgacacgattttttgaatggatatttgaaatttttcatgatttgaaagtccctgagccctttattttcatgaatgattatactctgcaacaagggagactatatttaatgatgtgattagcagtttgtgacatatttcattttgtgttctcatgtaattgagttattttcaaatagtaccttggggagatgaattaactattttagtgccctaggatttagtttaatgaagtacttctctcaatgttacttcaatgttctagaacagtgc

SEQ ID NO: 16266 - DNA, 1178 bp, Homo sapiens
catgaactacagagtgtggttaagaccagtattattagccaaaaagaaagttagattttatacattagctctcttctattaaacatgataatcagactgaaatattgaagagtttacttgaattttcttagttgtgggggataaaacaatgatgttttacattttaaaaaattagaggtattacacttttcaaatctttgtttttgtatacctgggaggcatttttttgtgtgtttgtgatgtttcttatttgcattattacagatgcattgattgtatattattttgtgaagttattttatttctatgttgcatttttcttattaaaattatacaatctttcagatgaacaggaaggacagtgtctgtaatctctcctcaccgccatctgcagtagtcgtacaaaggtgatgttttatgtgagtaagaatttctgtgtttcatttcacaggtggggagcattaagcgggaaatgaccttcacatttcagtcagaggacttaaaacgtgactgtggtaaaaaaatgtctcatcaacacgtgttttccttggccatggaggaagatgtgaaaacagcagacaccaaaaaagccagccggatccttgaccatgaaaaagaaaacactcgctccatctgtctccttgagcaaaaaagaaaagttgtttcctccaacattgatgttcctccagcaaggtaagggaacattaaatctcacatgtgtctgccccaggaagttggtggagagcatgcataatctctgccagtgtacagactctcttcagtatatagacatatgaaaggttttctgccaagaaattttttctattgcttgtgtgaaatagagcaggtggccttactcttcataactgactttgaggctgctgtagttggaactattgtagctctagaaaagaaatgttttattcaattttaataaatgaataataaagagcaaaggaataaatgcaaaaaattaggatgaaacatcatatagaggactgagcatacattaagtaggactgtagccacttcaaagcaagtgtacacagatctttggtcagaggttggtaaactatggctgcaggccaaattcagcccctgatctgtttttctgtggcctgtaacataagaatggttttactttttttttttttccaaatagagatagggtctggttc

SEQ ID NO: 16267 - DNA, 1824 bp, Homo sapiens
ataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcgctctgttgcccagggtctgtctctgactgtgctgtggtgcagtcatagctcactgtatccttaaattcctgggctcaagtgatcctcctctttcagtctcctgagtagctgggactataagttcatgccaccatgccctactaatgttttaattttatttttgtaaagatgggatcttcctatgttttccaggccccttggcctcccaaagtgctgggattacagatgtgagccaccgagccaggccatgatatttacattattaaagttaatagttcaaactacttttagaggctt

SEQ ID NO: 16268 - DNA, 1200 bp, Homo sapiens
agcctcaggatacagattactttttcagctggaagaatgttatatttatttctcagtaggagaaattagttgtctttgtgcttgcagatgggaaaaaaaagagtttgatttgtgaagcatgttgaactgaccagatctgtggtggccaactccaggggataaatttcctgtatatggagaatacctggagcattgctgggccctgacctattatatagtcacacacggtaacaacagatggttgccagaattctacaacagagagtttctaatgatcagtatttgtgaaaagcttactttttagaaactagtggtttagagccctcaaaattacattctactctatgtctctacttttgtgttttgacttaatgactttattgtgttatgtgaatttagtaagtccctaatagctttgcctgtcttattgtactgtcttaagttagctagaaatgttaataattatacatttgtttatacccaataacttcaaagggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcaggtgggttcagagcctttcttttgtaaattagagagggagaaatataaaaacaggttggctctcttatccaaagtgcttgtgaccagaaatgtcccaagcacttttgacattttggaatatttgcatatacataataacatatcttggggataggacccaagtctaaacacagtattcatttgtttcatacacaccttattcacatagcctgaatataattttatacaatagttttaatttttgcatgaaacaaaatattgactgtggcttgactgcagcctatcacaaggtcaggtgtggaattttccatttgtggcatatgtagatttcagcttttacctgaagtttacttggtaaggttcttttatctctcttagtaagtctaggataaattagtgaaatatgttccaactacctttaagaaaatatgttccaac

SEQ ID NO: 16269 - DNA, 2333 bp, Homo sapiens
gtctctgccaacaactcttttgtggaattctaatttataggaaacattttagtatgagcttcagtgtcacaaagaaaaccagatctctctctcttttttttttattttttttagtgatagagtctcactctgtcacccaggctggagggcagtggtacagtcttggctaattgcagcctccaactcctggactcaagtgatcctcccacctcagcctccagagtaagtaggaccacaggcatgcacaagcatgcctggctaatttttaaattttttttttttaagaaatagggtcttgctatgttgcccaggctggtctcaagctcctgccctaaagtaggcctcctgcctttgcctctcaaagtgctgggatttcaggcatgggtcatcaagcccagctgacccagagctctttactaacttatctgtctcttatttgcactcatggatattcacagtaagcattgtttgacatatattaaaacccatgaaatatgtctacttcaacctgtgtgaaaatatagttaacattgcaaactttagaatgtattaaaaattttaccttgccatagagactgaattagtcacagctctcagtgatgttagatggaaacttatatctcaaatgataggattgtgatgctttttttgtaacaagtgattctgcttaatattttgttattccagttcataaaaagtagattacgttttcctataaggataatttttgcagtgattatattgctaactctcattgcatgatacctttaataaaatgaacaatataagagttaagggcaatgggataaagctacttaatgtgtctcctccactgatcaaaaatattccatatagtcttggtgaggaattccccaggatataaatggctatttacactgtaatgaattataccatatatgatattcactcagtaatgttaataatgaactggctaataattgacaagatgcagtgcctgccagtttatgacattaacttggtttgaaactaacatatgacatagtaccagtgcagtcagagctgcccttaggcatgatgaacatgtggcccgtttttgcctggtgttttggcagcaaagcaggaagcaattttgtgtgggtcattgttctgtcaatttgtggaaaaaattacttcagtctcatataaatatagaatgggtccataaacccttcaactcatttccatggcaaaactcacttttctttttatacatgtccttcagtctcttaattttgtcaggtggagcttgatcttaattttaacctattatcttttatttttgtttgtttttggtgaaggataagagtggtgtttcttttgccctttctggtacaaacagagggacactaagcattaacttaataatcacatttaagacttgaacacatgctacccttttgtcatcttctgacataagtttacctgagtttccttgatttggaagatttgtttcttttatctctcttcctctggatgtagtttttttttgttttttttttgtttttggacggagtcttagtctgtcactgaggctggagtacagtggcacgatcttggctcactgcaacctccatctcccgggttcaaatgattctcctgcctcagcctcttgagtggctgggattacaggcacatgccaccacacccggctaatttttgtatttttagtagagatgggttttgcaatgttggccaggctggtctcaaactcctgacctcaagtgatctgcctgcctcggcctctcaaattgctggaattacagttgtgagccaccacacctggcttgaatgtagattttaataattgaatttattctgccgtgttgatagaataactgaatatcagtaaattgtgtaacagtggtggatactgttgcataagatgagctcctgaagagtgaagctaattctttggtcaatgttcttttcccctcagtgtctagtttaaggcttttagaagattgatctgtagcaattatttaatgaattgaatatttaaaaaattttttatttgctgtctttggtaattatctctctgcttgaaattaaatgcactataagttaatataacaagtaaaatacattgtcttttgaaaatagtttctttttaaaggaatactaattaattgtaacttgtaaaaccaaaagttctaatggtttttaaaaaccagtgttgagtggaaaagtgtttctttagtttggaaagacctgtgaagtatcctagtcagggaaagaacctgttttctggaagaatgtaagttgctatatgtggaggggcatgtaggacaggggttctaattactgtctgtgag

SEQ ID NO: 16270 - DNA, 1143 bp, Homo sapiens
tccagtaaatcattcctgtttgcttgaaaagtgtagtgtccaaaacagaatgtagttatttgattctgacctagagcaagaaaatcacctcctcatcaggataccatatttctgttattgcaacttgaagtcacctcattttagtggcagcagtctcactttaaatactgggtgtgatcagctaatgacttaatggggaatgtaagggatcattttagataaaaggccaagatgaaaaatggacatgtgaaaatagtttttttttttttttactacgacttgccacatattttcaagttgaatgtcttctgttaatttctctttattttgtttgccagtgaatatagaacctcttttttaaaaagtgtttttgaccatcagaggggagtatacctatttgtgtctgctgctctcctaccttcctcctactctgtcaatgtgatagtttgaagctgcgtatttgccttgttctagggcaagagtgctgacttcactaacttcgatcctcgtggcctccttcctgaatccttggattactggacctacccaggctcactgaccacccctcctcttctggaatgtgtgacctggattgtgctcaaggaacccatcagcgtcagcagcgagcaggtttgttttgtaatgacaggtctgtttacgggtggagcatttagtcaaggcagaagaccttggcctccagagtgagagagaactgagatttaatccttctcctgctacttcttgctatggaaatagtgcctttgatggtgcctagcaaataaacagcgttcagtaaatctttgttgttattaactataaacttagttcgtttagtctctaaaattgaatagtcattgtaaggattcaatgagaaagatgtctgtcacctaataaatgcctttttttttttttgccagttatgaggaaactaaggcttagaaaagtgagagttcatattcaaggttacgcaggtatcagtgagttaccagcctactactcactcacataagggctttctgctattttatttatatcagaatgcatttctgaatcctgacagatgagagtcatcccttggagaacatgtatctattaaaactcactccaggttgctttagaggcttagagcaggtattcttacat

SEQ ID NO: 16271 - DNA, 1152 bp, Homo sapiens
ttctcatgaggatgaactgaagtgaggttcacagtatacttagcatagtgcccaaccttaataaatgacaaaccctacaacctctttttagcacatctttttttttttttttttttttttttttttttttttttgagacagagtcttgctctgtcgcccaggctggagtgcagtggcgtgatcttggctcactacaagctccacctcccgggttcacgccattctcctgcctcagcctctcgagtagctgggactacaggcgcccgacaccacgcccggctaattttttgtatttttagtagagacagggtttcaccatgttagccaggatgatctcgatctcctgacctcgtgatccgcctgcttcggcctcccaaaatgctgggattacaggtgtgagccaccacgcccaacctttagcacatcttttgaaccaattcagtgttatttaatttcttcaagtgtctactactttcatgattgaagatagtttagcatttcatattaaagtacatttaatttcattacagtttgtgaaagagacagacaatgaagtaagaatgcgactattgcagttcgtcactggaacctgccgtttacctctaggaggatttgctgagctcatgggtaaatgtaatttcactgtaatttctctgtacgtaattttgtgataataatggcctttggacatacaatagacttgattgaacctaaagattactcttctgtgctgtaggtagggcttcatttagaagaaagaaaaatgagtggctaatatcaaagcacttgtaagacaaaaatgaatgtgtcctcatatagctgaggtggccattgctttgctccctatggtgactgtgaagggagcgacattctgtagagagagttttcttcccaatgatctaattcttattgctggatctctgcaacaattttcttcttcaggcagaagcagcttacattgtgaatttctttattttgtatcattcatatgactgtgcaacatgttctattatttaagcagttgtcagaagaaaaaagtttaaaggaccagataaactttgtcttattttcttggtgtaggaagtaatgggcctcaaaagttttgcattgaaaaagttggcaaagacacttggttaccaagaagccatacat

SEQ ID NO: 16272 - DNA, 1108 bp, Homo sapiens
gtttttgtttctgttcagttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgt

SEQ ID NO: 16273 - DNA, 1149 bp, Homo sapiens
gaaatatggtcccccactcaccttctccccttcttcccttcccattcctgttctgtgctggactaaccgaaagaaattaggagtgcaagactctctgtgcccaaaacacagttcatgaggaaacagacaagagggaggctcagagacaggtttatattgctacttcattttggtgactcccccacccccaccaccagtaaatggcccagggaatagctcacaggcccaatacaattctgtctgttagatcagttaagcaacacaattctatctgttagatcagtttagttgtttgtcttccagggaaagcagcttaccagtgttttttttgtttgtttgtcccgccccccccatgtacttcccaagtagttgaaaatgaaaaggttaacaaaaccttttcccctgatgacttctgttaactacctagctcttcctaccctgacaactaaataggatggtatgtgtcaactgtatttattgccatgcagctttgcttttggtaaatatgaccctgactggtaagttgcatctggactgggaaatctccagatacacgacagaaagccacagctttgggcatacctgagtggaaaactcttgtaactgtatgtcctttaaggaggaccgtgagctgtcacctggggagataccatttcatagattgctgttagaagaccgtcttctgagaggaggttcaaaattgtcctgctggtgagctgtgtggttcctgtcctatagccttctgagtagactggtgccaaatacagcctattgtagacttattaagtctgaatgtttggttgaacctaagatgatgtggtggatgttgcagaagtaaaaatcttcctctgttgaaataatacacaactaaaagttctcctgtaacactcagttggccttaaaagccaagctttaggtcaactgaggatttgatctaagtccaaaagtgacatctcctatattccaaaatttctctcctcaattctcaaccaagaacaaaatcagagataatagtagttgtatttactggtattcatggtaaatcctttacataaattattctcttgatccttacaattccatgaaattggtggggttgtctttaatgatgcttattttatacatgaggaaagtgagtatgagagaagc

SEQ ID NO: 16274 - DNA, 1427 bp, Homo sapiens
caggaaaattcagttgctaataaagtcacttttattttgtttttcacaaggctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttctt

SEQ ID NO: 16275 - DNA, 1417 bp, Homo sapiens
tatttttcctataaactgtcatatctgcctggatgacatatctgtttacctgtaaccaattatactttgtccagaagttacttttccttcatcaaaaggttttgtttgtttcctgcatgcctgacactgttgtcaattgtagaaatcacagtattcctttcatttcatccagccttgttaaagttttgggaggagtttgaatttacactgtgtttccagtccctaaaagatctttcacatatatcatgcagtttcctaccataagcgctaataactttaattaatctgccagtgttctttctccaactaaggccagtttagtgacaatgtaatgcatttcctcattgaacctgactatagttcaatacatactttttttaaaaattgatgaatgttgtttgcttgtttgtttgtttgtttcctcagtgcaaaacctccttatctctttcagctaaaggtggggagatttctatctaatagtaatatttgaaggcaatcaggattttgcatcagaagagaaagccattaagaatggatttttgggccgggcgctgtggctcacgcctgtaatcccagcactttgggaggcggaggcgggcagatcaagaggtcaggagatagagatggtgaaaccctgtctctactaaaaatacataaaattagccgggcgtggtggcgggcgcctgtagtcccagctactcagaaggctgaggcaggagaatggcgtgaacccgggaggcagagcttgcagtgagccgagatctcgccgctgcactccatcctgggcaacagagtgagactccgtctcgaaaaaaaaaaaacaatggatttttgtaagttaggttcaacatttttttggtcttataaaaagacttgttaagtcagaacgagaggagtaagggcctctcccattcaaatttcacctcttggcgaaagatgctctgttttttggcccttctcaagagaagtccttgtagaggtagtgactttgacaactagtttctactaagctatagaaacccacaggcttaatccataatacattccccacccttcatcctgctcttctgcaaatcattcgtcaacatgtattgttgcttattattcactaagatcttatttgtgatgtagtgaaaatatagatacaacaaaatgacaggtaaattaaattggagagcagaaacatacacacatatacagaatcgcaaatacacagccacactgcaactatcaccatgaatcatgaacactgctaccatcaccaacaaccagtaatcctaaattggagtaatgaaagggaataaatctagaaagatatctcatttccaaaactgtgtgaaagtgattagatgttttaaaataataggtttgttttaattaatatagctactacactgactctcataattagttgata

SEQ ID NO: 16276 - DNA, 1391 bp, Homo sapiens
attctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttctttgctttggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagcttaaatcctaccttgtgggactgaagtgctcttaatataactgtttattttcactgtgtaatatgcaaagcaaaagggaaattatttggtggatggtagctcaaaattggaactcttgttctaattcagttacattggctttaccctccttagatttttcatcaaagggctgtcccattgcaatcttactaaaacattttgttaaaataaactcttttcctttttatattaataattaggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagctttaaaactataaatatgcccaaattttgttatttgccctactttaagtaggtttattgtgtttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcgttttatttttaaaatagtttataaacttaatgatttttttttacaaatgaggttatagatattaatgcaaattttctggtaggtatctctttttttgctatgatg

SEQ ID NO: 16277 - DNA, 1178 bp, Homo sapiens
ggaggttgcagtgaggccagatcgcaccactccactccactctgggcgacagagcaagactctgatccagacaaagcaaaacagatatttagagacagagtagcatattgaattatcagcaccagaatgccattctagggttatctggcttcaaagctcagcgaccacactgctaattaagaatgcttatgaagaatgtttaatgatatgaggaagacttacaaaactgtttttacaaagttatcaatgtgtggattttatttacatgaaagaaaaaatagtcacaaatgttacctttcaatggtagtataatagaatattaaaatttacttttatttcattctaaattttctacattctgcatgtattctctttataatcattttgtaaactcagaatactgttgtaaagatgtcagctccttcccgaggaaataccactagttagacttaatacacacatttttttatgttgaattgaaattttacttggtaatgaatcattccctttaatctactcttctagattactgatctctcattacccaactatctgatggcatcttcggttggactgcttcctacccagcttctgaattcttacttgggtaccaccctgcggacaatggaagatgtcattgcagaacagagtgttagtggatattttgttttttgtttacaggtgagtttaaggccaagggttgtctctttttttctctctgtttctttttgtatggcattgctgatttgacagatttcattgaaaataatcagagggtttttccattttagatttttttcttggttctttcattactactacatattttgacaacattaaaattttttaattgtgtggatatatgcaagtgtagaactgaattgatacagaaaaatcctcttaaagaggcaaaaaagaatgacaaaaatagggttatttttgcagtgattattttcagagtcatcacaaatcaaatactgtattttgattttgtgtgaagtgtatctgaaaataatttcagtaagattgggcagagttgagtgcttatcttatttatattcaaattattgaaactcacctatttgtattttttagtgttatgttgagagtgtaaatttctttctagtacaatttgatgtgaaacaaaagatttgttttaaaaagtattacctcgtaaa

SEQ ID NO: 16278 - DNA, 1167 bp, Homo sapiens
cctgcccgtcgcccggctctcccctcgttgcagcctcgctctccctagagctccttctcccctcccagtggtttccctccgcagctgtgggcctccgctggcccacgcggacgccccgcgacccccgcagcctggcgggcagcgcgtcacgggagcggaccagaacacagcccgctccgccccatcgcccgcggccccgccccctctggccgacaaggggcgggcaccaccggagtgggctccgtgggtgctggggcaggagtttcctcactccccgcctggccgtcgctcctccgctgactccgcgcccttctacgggccgtctcccaccctctgagcggacgcagggagtcgatgccgggcgaaccgggcgccatgaagggcagctgcctaacgggcgccgcggcggaggggctggccggctgagggcccgcgctgggccgaggcatgcggagcccgggcgggatcctgctccaggcgctgccccggctgctgcagcacgccgccctcccgggcctcgccgagctgccggcccgctgggccctgccgcggggtgcgggcggggacggcccggcggaccgccttccccgcgggggcggggcgagcgcggcggcggcagcagcggcggcctcgggcgccctgctcggcgcctatctggagcgccacggtccgcccgaggcttcggagctgccggagccgggcggggccttggcgggcggccccgggagtggcggcggcggcgtggtggtcggcgtggctgaggtgagaaactggcgctgctgctgcctcggcagcacctgttggtgccggagcctcgtgctggtctgcgtgttggccgccctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggaggga

SEQ ID NO: 16279 - DNA, 1989 bp, Homo sapiens
gtgcttttttgtttacttcataacatttatagttactacaagtagcagtatggtctatcagttgcagtcaacagatacacctactcttataaggactttgtgtattcggtctgggggtatatttcataacaatcacatgtaagctgatacaagttccctaagcagatattttttaaagtttctaatattttgtttttatattgctttttattttaggttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctcattgcactatattatatgcaaattgttttgctgctaggttttcaaaatttgaataataaagccttttcatgttcttttacatctcttatagatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttcaaaaattaccttgttttattccattaaaaataatgtcacttccagagttgccttgaaatcttgctgtaaagttttcatgtttaggaatgtacctgtttctttatataatattcatttatgttttttgtactattttcaaatggttttatttttaaaatatagtttttaaatccatttgtaatacacttgatgttaggtataaaataatcttacttcttttcctaatgg

SEQ ID NO: 16280 - DNA, 1214 bp, Homo sapiens
ctttctttctccctcccctcccctcccccagccatgcctcccagcgcgcttcccttcccccgcctcctggtcctgcaccctcccctcccctccccccgcttcctgccttgtgacacatcccgggccctcccggaggcggcagcagcagcagctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagaggtaaggccagcgtagatccctctactttgcaaggaagtagatttgcaaggaaacgcccagaaggataaagacctgggagctctagcttggaggtggaggtgagcctctcgcttgggctgaggaaggatgctgactgtgccttcccaggcaagcccgcctgcctgatagcttctccgcagggtttttctggtggtggtggtgatggtggtggtggtggtggtggtgatggtggtggtggtggtggtggtgatggtgtgtgtgtgtatttcaccacttcttacccagggctacagtatgtgacatgaatttcccaagctctgcttagctgttttcagaacagcccctaagcgcagctaggaggtggtgcaaatctttcacaatcattcacaaatctttttccgttgctgagaaaccaggagtattgctcaccttggcatctgtccttgaaagggctttagcttgaacaatatgcttctgctaccattcacccaacagtgctctgttcactcagtgaattgccatatccaaaatgaatacagttaatcaatattcctaatatgtctgaaattcctgcccctcctttttactcctactttcaaggagtatgtgttagatttaattgtgaatgagaaggaaggaccttacttctcatagaagggaagatgggatatttttaacacatatctgggtgagattgaaattaacttgtaaaaagtaacccaaattaataatacatatatttctatttttttctcaagaagaataaaaaaagattaaatgcaatgggatctggagaaatatggaatctatttaccatactattcgatttatttaaaaatcgatcgttgttctaag

SEQ ID NO: 16281 - DNA, 1188 bp, Homo sapiens
gaatctggaagccgccgcgactgggggaagggcgcgtggcgggtcgattctggggaatctcaaggcgtgacttatctggatcaccctagacttcccctagtagcaagtggcctcttctctcttcacctaccccggcggccctttaattccccaaccttcagaggcttccccttctgaggcctgcggcgtgccccctaccccgcgccgccgccggggtgcaggtgtctgaaaatacctagaagccgccgtcttggtccgctcccaaacccacgatgcctcccttttctatacctgccccagttaccgatacttgtccctaatgggtgtattttgaatggacccgcctcagtttaggaggttcagaaaggataccggaaagatttaaaactggctacagtcaggtttttttccttctcttatctcgccaaacaaccgaaacatattcaagattttgttaatgaagttttttttttttttggtctcagctttatctgggatcttctctctctgtagctgcctgttacgtgatgactctttcttccataattactttttctgtacccttcgcccgttaccatccccttattggttcctgtttctcatctccttttactcctgcgtgtctgacttaatgattttaatggcttttcagccaaaattcagggcatgaagaatgctgttcccaagaatgacaagaagaggaggaagcaactcaccgaagatgtggccaagttggaaaaagaaatggaacagaaacatagagaggaactggagcaattgaagctgactactaaggagaataaggtatgtgaaataaatgtttgtcgttgcctacaccatttgaaaacagctgtccacttctgttaaatgttaaactgcttttttttttttttttgagacggtgtctcgctttgcaaaacacgctcaatcttggctcactgcaagctccgcctcccgggttcaggccattctcctgcctcagcctcccgagtagctggtactacgggcgcccgccactacgcccggctaattttttgtatttttagtagagacagggtttcaccatgttagccaagacggtgtcgatctcctgaccttgtgatccacccgcctcggcctcccaaagtgctgggattacaggcgtgagccaccgtgcccggccctgttaaactgtttattatctaaaat

SEQ ID NO: 16282 - DNA, 1166 bp, Homo sapiens
tgtaaatttagtgattaggtcttttatttctcagggctgatgtgaaaagccttttccttggttagaactgatacttatgcaagtaatgtaagtgcttccaaaataacaagtggaggcactgtttgacgctatctctggggaaggaatttcaattcatctgtacttttactcgaattctcttcgtatatttcccagagtcttacagtaaacctgattatacaggaactacattttttttgtctttcatggtattcctttggatgcaggtttgggcttcaaaacacatgtcaagatagtgaatatggtggcaatttttggggtcaacgcttggggtagagtgaggtaggtttgttatatagggagggtatctgggcctccaacagaagaagaaaagcagaaatggactgctttgttcttggatggaaatgtggtagaaagttggggtgaattaagtttggacctgggagttagattagattctggaggataatggtagagaaggagaatgttcataacttgggcatttttgtcaggaattgtgggaactataaaagggattttgtaacatgagttacaaaaattattaagtgctgtattctgacctaatctctacagaagaatttcagaagtactgtgaagatattgtaaacacagctgcatggggaggtcagcttgaggtaagtttgtagttattcatagtgattgtgggttgttaaattatttctaaatcccttctgtagtttttagatgtttctcagctgatcccaatttctctttgaagattccttttctttatatatttgctcttctcaactgacaaagaaatagggagttaacatgattaggtctgtgattaaagtatgtatgttgagggattgaaacactattacattttaaatagctcagtgttagatctgtgtgttagaaatacatatgtgtaagtcttttcatcgtgatagtagtattggcaatacatttgattttctggacttaggaaaatgaaaattttactgaagtaaagtaaaatttagcctagtagctcagctgatcaaagtcactattggaaaaatatcttttttacatcagaaatggaaaaaaaaaattatgtgaaattataggccaaatcctaccacaacatatatattaaaatcgtattttgaattcct

SEQ ID NO: 16283 - DNA, 1301 bp, Homo sapiens
tgctttccttgaaggaacaagcattttgtggcctttaccttgtgcaattttagggagtagcagtgtaaaaggtccaagaccacatttacttgaaattcttcctcttttctgatttgtcttaccagatatttcccttcttgcctcattctctaggatttgaataaaacctttgccacttattttattagccttattaatgtcacctttccttcaactcaaatatttgagaaattttatgttacatatatgaatgaagttgaaagctactgtttggaagctaagacttgtatagagtagttttgtatatgaatggttgttctagctcagatttcaggttactcacaacagtattctttctaagaggatatatacaaatgtctctcataatttatgtaaggaaatattatgaaaatgagacttttttagtttgatgtgtgtttcccaaactagagataaaactagtaagatttagtatcgtttataacatttgaatttttgctccatgagtacaactaatttttataagtaaatattgggtttatatgaaaaatggggtgtcagtcttttcacacgcccagcaggtaacaatgtgggaagctggcagggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataacttattggcagctttattctttttttccttacaagatttagaatctttttggttatatgtctatttttcaattttgttatatttttaatttaagtggccaatgtggttatgaacaagatttgtatggtcagcttctgttctttcctaaaacttcagataaatatcattttagctataacctaaaaaagtgtttaaataaaatgacagatgttaatttaaaagcagcatatgctaatttactttttcatatgatgatggtctaatggaagttacatatgctttcttttgtcctaactctgaaaagtatatgtcagagttctggaatatgtctttagccaagaattttattcacttaaatttgtttacaacttgtataaagcaaaaaagaatgtgtgtaact

SEQ ID NO: 16284 - DNA, 1133 bp, Homo sapiens
tgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagctttta

SEQ ID NO: 16285 - DNA, 1320 bp, Homo sapiens
acagaaacttactgcctgccagccaagagcctttggtctctcattttgtaagagaataaagcttttccccccttgaacattctattgtctcatgaattctgatgagaatggattcctttccaaatataaaatcagacaaatgtgaaagcatctagaacagtctctggtccaaaggagatgaaccacagtacgtgttgtttcttttgtatagatgattcgtcaatctcactgctaactccaaacaacttaatttcaaagaaggaactcccgacactgacatggtaataaaacaggtagccattctttagttacttggcaatttcttgctgatttcctagccaagacctgtagggaaacaggtgctagaggagtatggtaaaccagcctctttcccctgtgactgctgattttggcaaaggccacagtaaatcagtaaccatcagggtgagggcatctcagacccacatgcaggtttattttaagcttcttggctggcaccactgagactgctggatcatctccatgttgtcaaagctaacctccaatacccctaagggtcttatcacctgcccccaagaacatcaggccaatctgatcaagcattgctcattttcaaatccatcctagggcaaatggatgactaaatgttaaggttcatattcaggaaatgtcattgcatttttgtttatcacagaaagcatttgtgtaaacaggtgattttgcacattgctttcttagtaccatactatttttgaagccccttcctctctccttccctaccttctcgacaacgttcctgggttgtttcagtgctgctttccaacactttccaatgttgaagtatcaacaagtgctctggtggctaaaacagtctggggtcaacgcagtaaacccaaggacctgttctggccctggccagttggccatgtgataacaaacagcacttttgaagcaagcccagtgggtggctaaatggagctccatctagaaacaggaacaaagccaggccagaggagaatcaaggttgagatactaaagaatctcctccagttgtaccagcagttggtacctctgcagaagggtagtttatttataatatacctctcactgaaccatacaactttacaaccagaggacaaaacttatacctgtaaatgagattatttcaaagctatcactttaggaaggctttattctgatttcaaaaacaccttggcattcaatacttatgtcaaaattcttttgactatatttagtggtggcaaataccagtttttttgagagtgggtgttatttttagaaatatccaggtcattcaga

SEQ ID NO: 16286 - DNA, 1161 bp, Homo sapiens
gatagggaagggagaagatcaagctgttttctattaagcctcatccactcaaagtaaatatggtccaatcggtaaatcagataacatgtagcaagttgtgcaatttggttatatttgtctaggaattgaagttttagtcatgtgtttcaagcttattttagaattaaactctgttccttgtacaatgtggacacttaataaatggtgaatgattagccaaacgcaagcaattgaggcttttatagctgtccaagttctgcagaagtcattgtttagaagaaaatttgtcaggggacattgtctgcaggcactcagaatagtccagcatttggcatagcgacgtaggctttcctacaatacagcttctaacaaaactaggctgtcctgaacccctggtaatagaattgttcacctttataccaagaaggttgggaaagcaccaaaatctgcatgtggtgtgtacccaggccgacttcgaggggttcgtgctgtaagacctaaagttcttatgagattgtccaaaacaaagaaacatgtcagcagggcctatggtggttccatgtgtgctaaacgtgttcgtgacagggtcaagcgtgctttccttatcaaggagcagaaaatcgttgtgaaagtattgaaggcataagcacagagtcggaaagctaaataaatacgaaacttttttgagtaataaaaatgaaaaaaaaggagaaaatttgccaagaagaaagagtcctttaaatggcaacaaattcacctgtaccccacctgtgaagacctctaggatccgaggtccctgttgttgctgtttcttctctcttctgaggtcataccctcctctttcttaaacggtactttcctttgaagtgaaaaagaactgggaaaggagtcctgagagaaaagggctgagcatgaacactacaaccttacataacagacatttttatctcacgacttaaacctaatactgttttccctttagtggctatatttatttttgagagcacagtatttaaaaatggcatgccgtgctgaattgctctccaccagtccagtccgccatgggactttgtgatatcatcggagtggttggctatgtttatgtttgatggccacgggctaatgaagcagtgcagtgtcttttatggatagacagtggga

SEQ ID NO: 16287 - DNA, 1172 bp, Homo sapiens
ttagattttaattaattagttaattttttttttttagatggagtctcactctgttgcccaggctggaatgcagtggtacaatcttggctcactgcaacctccgcctcctgagttcaagcgattctcctgcctcaatctcccaagtagctgggataacaggcacttgctaccacgccaggctaatttttatatttttagtagagacagtgtttcaccatgttggccaggctggtctcaaactcctgacctcaagtaattcacccgcctcggcctcccaaagtgttgggattacaggcatgagccaccatgcccagcagatattaatttatttttaaatatctagttctagtttatatatataaccagtatgtcctgttttaaattagaatcttttatgtaaaaatacagaaaatacagaaaattaggtttgagttctgatttaaatatatatttgtttcttttagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacaggtaagactgctttttattgataaggtttatgcttgaccaatagtattacagtattctttaaatgatgttttaagaatgaatatgttatattagaaaattgttgatgtaataccactacattgttggtagttcaggttttttgttgtcataatttatctttagtgattggattaataactgtgtgattaaagtgctttatagtagatgtatgcttaagactgttgattataaacttggtcaaatgtgatcttttcctcaagaaccaagattgtgtttaaagataggatttatacattttttttctaaaaagcatgttaataggactaaaattggagagttgaacttgaaagtagttacttgttaattcattagagtctggagtacttcaaatcagagttgaattattatgatacatacttgcatgaaaaccaagcatttaacaaatgctccatccctctattgttgaactgagttaaaataatgattatggttctttttgtatatgtaagagaacactatttgttaggtaactaaaaaaa

SEQ ID NO: 16288 - DNA, 1224 bp, Homo sapiens
taaccggatgagggggagataaaactgaaacaagttggtcattgaggaaatatgggggtaacattttaaataaatttttgttaaagtgagttttattttgctgttatgtatgtttgtacttacatttttctgttattttaaatcctttcccccacaccttaccatgtgttagaatttgccaataactagattgcttcaccaatggactctgctcaactaactgctaacctgagaacaataagattttttagactcattgaattcaagcaaatgtttaactgtataatagaaaattaaatgttttaagcatgcagtaaaaatgttcttttcataacatttcttcctgaacagtttttgtgactataaataaatattaaaaaatctacgtacacacacattatacttttttaacaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaaggtattttcattttgcattaaaaattttttcctcaaattatttttgacacatatattttttcccttacaatttggaaactagggtttggaatgcccagataacatatatacatgtaaatatacacatatacctacatatgcacacatatgaatatatgaatacttgtagacttttaaaattagaaagctttatttcatcatttcatgtgcaagatatcttgaaggtcttgatttgggattttcaaatggtgaatcctaaagaagtactctgatttaagaaaatatattattagaaacctgaatttataaaatttttgcagtcattgtaaaattccagagaatttgtcattatacccaaggaattaaatgttttatgcaaaatttgtgtaagttgatgtgtattgagaaataaatactagttaaacaatgccttaaggtcaagaactttgtttactaaatgtatcgattttatttcagcacttcagaagataaagaaaaacagtatactagccaaaccaccaggttgcttgctcttcttgatgctctggcttcacacaaagcttgtaaattagcta

SEQ ID NO: 16289 - DNA, 1150 bp, Homo sapiens
aatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtgaacagattttcataattctcacttgttaaagtgctgcaaaaattgcattttcagtactctaaattactacattagaagagagcatttctccattgtctttattttctgttatatatgtgttgtaaaagtacactacattagaagggagcttttccgttgtctttattttctgttatacatgtgttgttaaagtacatgcattcttagactaactctcagatgctttgctcttttggagctgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaattgttaatgggatgttttaaataatgaatttttcatccagcatcagttgaaaaggaaaagaaagcttcattatggaaatgacaatattgaatatgacagataagtttatttgcttctgttttaactgcagttaatagtactagacaactttaagtggaaagcatttagtttatttcttcacttatttgtagagtgaacaaatgattcacaattctacaagtaattccacttaggtaacttacagttgttaggtttgacaataaagatctactatgagagga

SEQ ID NO: 16290 - DNA, 1751 bp, Homo sapiens
ttaaaattaggcctaaataatctcaaataagtacccagaagtctggtttgactttgatttatgaaatcagtgcatgatttcttcccatgtataggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagtaaagttttgccattgcttggagaaacttttttttccttctctgcgctgccagctgtaacacttcttctggattgcttgcattcaactctgtctggccgatggctttgatcttccaaaacagaaaagtgatgttattag

SEQ ID NO: 16291 - DNA, 1530 bp, Homo sapiens
ttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgttttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttcacacttgtcagattcttttatctttatactcattaatattaaaaggaggtacaacttactgtttagtttttttgtccaaaagatgtatttaatacacattttatatatgtttttaaaagcttgtatatattaaggctgggcgcagtggctcatgcctgtaatcccagcaatttggaaggccaaggcaggcacatcgcttgaggccagaagttcgagatcagcctggccaacatggcaaaaccctgtctctacta

SEQ ID NO: 16292 - DNA, 2005 bp, Homo sapiens
gtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttgctattgtaaatattagtggtttacaatgcgctttagacatatttctttaaaatgcaagcagtgagaaataagacctctctgaattagtagctctaaactgttaacatagaatgttacttg

SEQ ID NO: 16293 - DNA, 2648 bp, Homo sapiens
ttccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaatttggtttgaaatttatcagttatacagaattgtcatactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaagtcaatctagatttattttgagaagtaattgttcactctttacttttgaggcagccattaggttgaaagtatatatttatcatataaaacttgatgcgttttgcactactctttccatttatatgctgcaaacaactacagtctttgaaatatggaaaatcagcagtctaaagtttgttttaaattctaaatttaaaaaatcttcaaatctgaatataccgcaaatgtcatgagaagtttgattcagtaacttgtgatggaggattctttggtatcttactgtttggttaaggcactaattttacttacctattagattttgaaagtatctgagatatacaaatctccctgtaggaaatgtgaaagaaaagcacaacaaaactagggttttttgttcatttgcttgcttttatgattttttttggtttgttttaatatcaggtggatttttgtttctaagcaatatatacataaaatcaaccaacatatctgaaaaggatcatgaaacctgagaaatgctaatggagatttgctggtacataggaatctagcaaattcaggaaccaaggggaaatgttgtgagataacatttacattgtcaacctttattgactttgtttttacaataaaaaatattttacaacttactttctgttctctgtatattgtgacttgaggatttaccccctctgctaagataataaagatattatgcatattttgcctaataattcaacaactgtgagtgcctgctatgtgccaggcattgttctaggcagtaggttagagcagtgaacaaaactcccttttggatttaccgcacgaaggctcagaaaacattcttccaagtgttgaagatatggcttaatgttactgggaagtgccttaatataatttggctttgctgtccaattact

SEQ ID NO: 16294 - DNA, 1192 bp, Homo sapiens
gataaagaagaaaggaacacgggcatatgcctgccagtgtagctggagaactattgaagaagtgactgaccttcagacagatcatcagcttcgctgggtttgtggtaaacattaagaatgcagactgcacattcggacagatgcatccatgagagtggtctccatgaatcatcatcatgtttagacaatagtccctagcaataccattccctgtgggaaaaggcagtgaattttattgatacaactacatacatttttgaagaccaaatggactaaggaagatcatgtattataacactttggaattattcctgatacatggatgtttcacttagtaacaggcatctacattctttactaatctgtcttctgtttaatagaggtttgattatggagttccatacaaatatctagtttttcattagcaactgcaatattgattgctaatacgtttagcaaatcattccccaacttgtagcagttaaagtggataaagccggccagggcaaagagatcatttaggggtgtctacaacacttcttccagtcagatcttttgttgccaaagatcataatttggacatggcagaaaccaggtgatcagtggctgactgaagggtgttcagaagtagttacaggtattttgcaaaaacactgcctcatagctgatcttacctcatcaactcaaagcaatgttatgcacaatattaaatacatgttaccagttttagcttatttttccctcttttgttcatttaactatcaaaagttattttctattttgattacccaataatatataaaaagagtttgatgcacccaaaatcacaaaaatcctaatacatacaggttattgttggattttccaagtactttctatcctttaatgcctaaaactccatcaagggaagtaaacagcaagtaatataatttttcaggcagcctgtggacttctctggtaggatcaggttgacatatcgtttattaggtgagtaagtgaaaagacaagtaaagcataactgaaccaacaggtaacctgttgggctccttcctgacatcactgagatctgaggagccctacaatagcagcacattcaggaaatcaggtccctcaaaatttctagctcccaaccccattgagagattttgggagctttccaatctgccacaaactccctgctacatatgtacta

SEQ ID NO: 16295 - DNA, 1688 bp, Homo sapiens
ccacccagactttggggcgctattgcgttgaaccccgcgccaccgcgtgtgctccttcagtactagttctgtgtttgagagcctcgccttcatttatgaatgaggccactagggggagtgcacgtatcagggaagaacctgttccccggcaagcctagggcggtctggaaagggacagtcaccaatctccagagcccagggtgacggtgtgctctgattcctttggccaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagcctatcaaaggtctgtctgtaaaatgctcattttcttgcatcttactggtatcttctattgattgtaagcagtctgtgtttttcaagtgactttaggataatatatatgtgttttacatagtgagaagaaaaaagaaaagatgtgtattttaaagggcttacagacatatatgtcctacttcttagactacccaagtgaccaacaggaatgaacaacatagtcattgttttttcctgtggtaatggtttccaagttggacttttttttcctctaacaagaggccagtacccagttgattagcttacagatatcaactcactgaaagtaatcttttgttccctcatttcacacagcacaaaggttcgttctg

SEQ ID NO: 16296 - DNA, 2429 bp, Homo sapiens
cttgacaataaagctaatgtctgcaacccttgaatctcttctaaagtaatcttccttttggttgtttcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgcc

SEQ ID NO: 16297 - DNA, 1227 bp, Homo sapiens
aaagctgtagcaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattatttttttttttttgctctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttcccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttatatttctgattttcaaaaaagaat

SEQ ID NO: 16298 - DNA, 1196 bp, Homo sapiens
cccgaaccgaccaccgccaaccttccctgacacgcctttgccccacccgaccccgcccgcccccacgtgacgcccacgccccgcccactggcgcccacgtgacccacggtcgtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggcccccgacgacctggccttgctgaagaatctccggagcgaggaacagaagaagaagaaccggaagaaactgtccgagaagcccaaagtgagtatgggatgagcggcagtagagaacgggcgaagggcgggcgtggagaccctcgagcttgggggaggccgcgccccagccgggaaggaaaagagtgcttagtcgaaagccgagaggcagcactcccaagtggaggaggaggtgataggtggtcatgttatttggggaatggggggaactcaggaagtataggacgagtggggaagcccagtttcgaggaaggaagttaggaggtctgggggtccgttcagataggcgcccagaggtcaagccatctttgggaaccgtcaccgctagaataagcacagcatccttccttgaggcctgcagagtaggctgcatgtggagc

SEQ ID NO: 16299 - DNA, 1258 bp, Homo sapiens
tgtgtacatacatacactctacatatataatgatacctgggctccaccacaaagattcagattttaattggtctgggctgaggctccagggtctattgttaataaatttttcagttaattttaatgtgcagccaggttttagaatcattgcttgatacataatgtaatatatataaataaggaaagaacatgtaactaaggaaatgtcttcatattcttagtgggtgagtattcagaatatgtgtcattttcctctttgctctgttgtactttctttgagcaagttattctgctgtgaacaactttgttagtatatatgttatgttcaagcctcctgtttttaaattaaggcaatccttggtgatcaaaggatagtaggggaagtgagtaataaatataagtcaagcaatcatagaaatgtgaaaatatcccagttttaagaagtcatgtacctgttttttaatattcattttcttttctttaagtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattggtaagaagtgttagaaaaatttaactttatttaaaattactaatcttgtacatttttaatttttcagaaatagaaaaaaaaactatgaatagaaaaataagtactgctctgcagaaataatagtaataattaactcatctcacatcctttttgtagagcaaggtgggaattaaataagtaaataacatcatttactctttacatagtgctttcacatactttatcacatttgattatcaacatagctaactggtgtaattatatattcttagtgatgtgatacatgtaatgtgtgggtagactttttgattaatttcaacaattctgttgagtctaaataaaaatagtaaatggaagtacagttgataacatccacttatattttacagtctgcatggtgcctatttataattaaattttcctccggattttaatataaagaccagtagttgagaagtttatttctgttgagagctatcaagttaaaagcagcttaatttgtgtgtgtgtgtgtttgtgtgtgtgtgtgtgtgtat

SEQ ID NO: 16300 - DNA, 1152 bp, Homo sapiens
taaaaagggggagaaaaataagaggttgaatattgtcatgacttggtgaatttgaagaaactaattttgaaaagctcataaggataggagaggtgtagtataaaatgacaggtagggattgtaactttggtactactgttaagaattaattccaaaccctagacaataaatcaattacaaaaatgttataataatcaggggagaaaacaaccaggtcctagaccaagttaaaaatggatagagaaaagaaattcaggagattgataacaaaggaagcacagagagtggaatcaaatggctaataaattttctggaatttcttagaaattccatttaaccatatgatatgcttagcagaaattgaataaagattgttaccttcatgttatttttttttctggctcttaaaatgtgcttgggagacagaacaataacttaaaattacagcttagttgaacataaggaatttttagtttttgccttttaatttatggcaaaaatgatagacgcctaattcacactgttaaattttagatggtctgtcttctgctgatcccaactctgattggaatgcaccagcagaagagtggggcaattgggtagacgaagaaagagcttcacttctaaagtcccaggaaccaattcctgatgatcaaaaggtgagtataagagattcctgggtgtttatttgttaatgaaagagacaggctgggcacagtggctcacgcctatgattccagcactttgggaggtactgtgggaggattgcttgagcccaggagttcaaggccagcctgggcaacatagcgagaccccatctctatttataaaaataaaataaagcaactgaaggagaattctgggtcacagaggctgacaccaattgagagcctcagggagacaataatagcatcagaaacagcaaacccaagttttgataggactggaggagagatagtggataatagcaacacgtggtatcaggaatggttttgctagggttggggtgttgtattttaatgatagggagattttggtatagggtcagcagtctttttttctttttttttttttttcggagacagattcttgttgtgctgcccaggctggagtgcagtggcatgatctcagctcactgcaacctctacctcc

SEQ ID NO: 16301 - DNA, 1165 bp, Homo sapiens
acagtgaaaccttgtctctactaaaaacacaaaaaaaatagctgggcgtggtggcacacgcctgtagtcccagctactcaggaggctgaggcaggagaatcgtttgaacccgggaggcggaggttgcagtgagccaagattgtgccactgcactccatcctgggcaacagagtgagactccacctcaaaaaaaagttaatgaaaaattattcatttctatttgaaattcagtagacattttataatttcataccttcatttttatctcaacatatattcataaatgttgtaggtgatgattgatttggctgtatcactagagggcaggtatgagttacattgtttatctggaaaccatattagtattgaattgctgctaaaccacctcttggtattactgtgatatttaaactttatttgaaaatttcaccaaaaaacctgagatgattttttcctaaaatagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagagtaagtaatcctcattttttgttcctttgtactgtttacatttttcatgtgttaaggttctgatcttaaaagtctaatggaggccaggcgcagtggctcacgcctgtaatcccagcactttgggaggccgaggcgggcagatcacgaggtcaggacatcaagaccatcctggctaacatggtgaaaccccgtctctactaaaaatacaaaaaattagccaggtgtggcggcgggtgcctgtagtcccagctactcgggaggctgaggcaggagaatggcgtgaacccgggaggcagagcttgcagtgagccaaaatcgtgccactgcactccagcctgggcaacagagcgagactccgtctcaaaaaaaaaaacgtctaatggattaataagagtagccctttcttcctttgaaaatgctaaattctgccgggtgcggtggctcacgcctgtaatcccagcactttgagaggctgaggcgggcggatcactaggtcaggagatcgagaccatcctggctaacatggtgaaaccccgtctctacta

SEQ ID NO: 16302 - DNA, 2647 bp, Homo sapiens
catagaataacttaaaatatataacgagggcttgaaaacttaaacataaaatttgagtattttaaaacattgtttcatagttactacttttatattattgagacgtaacagtatttaccatcctcctaatttttttcttcgttttcccccttttcttttttagccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattttgttttaagagatggcagctggccgggtgcagtggctcacgtctgtaatcccagcactttgggaggccgaggcaggtggatcacgaggtcaggagttcaagaccagcctggccaagagggtgaaaccccatctttactaaaaatacaaaaaaaaaaattagctgggtgtggtggtgggctcctgtaatcccagctactcaggaggctaaggcagagaatcatttgaacccaggagacggagtttgcaaagccaagatcgtgccactgcactccagcctgggcaacagaaggagactccgtctcaaaaaaaa

SEQ ID NO: 16303 - DNA, 1576 bp, Homo sapiens
agttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatccaagatgaccttgtgattttgtgctgattgtgtctgaggacctttccctccacatatggtctggcagatgcacccagttcagcctaaggagtaggcttttttttgggggggggaggtcgggtgggggggatttttaatcttttaattttcaagatggttaaaatattgaaatgtttaagtggataactatattattcataaaatgactgagtgaaaactaatacactatgagatgaaaagtacttgtcagggattttcaagcttttgctcaagtaattactatgaaataacaatttctagaaatgaagaacaatccgtggagaataaattaccattggtgtgggggaaaaaagccaaacagaagtagaaaaaggtgtagccggcatacaaatgttatctacagtgtatttttagattttttatacttgaccaggtctcttatgtcctttttctggaaaactgtttttaactactaaagtgattataaatgaaaaagtggccagtaaagtg

SEQ ID NO: 16304 - DNA, 1204 bp, Homo sapiens
ttctgtaccatggaacatcgctataatgaatctattctagaaaaagttcaaagcaggtaatacctactgttcatttccatggtcattataaaactctcaaggcaccctgtgatcatgttacttaaataacccaattttcaatagactaagataatttactaagataaattagtaaaatggagtttcctccaaagtaccccctctcagtcaatgcatattgtgtatagaattactagatataagccaattaggttttgcagaataattttctaagaatgacaattttgattttatattgcttgttataatattaaataacaggaataaattttaatgaattgctttttatcagtaatttattatatgcacagagaaatacaaatcagcagggctctctgtatgcagctgattgggaatttgttttaaggcattaagctacaagctataaaaatgagagaagagcgattttaaaatatttacttggtatatccaattgatgcttaaaatataaaatttgacttcttttaggttccacaaatcaacaagacttttcttcagggaaaagtgaagatttgggaacagttcaggagaagtccaccaaaagccttgttataggtcctcttgattttcgtttggatagcagtgcggtgcataggattttgaaaatgattgtgtgtgccttggaacatgaatatgaaccatatagcaggctaaaatcaggtttgtttctggattaattttgaatcttttgccatttgttttgagaataattatataatccaatttgtgttgtcttgctaactttacgtttttagtgtaatttgcctgtttgcaaggactttgatatatgtagctgtttatttaaagaataaacttgtgtgtagaagttggagagatcaagatttgaaaattattgcacaagtactttatttgccagtatttgtcagtattttattgttatacctttttgatactttttctagtggatacttgtgaatatgatttttttttttcacattaatggattctaaggagccagatacaaaattgggctctaaacacacaaatttaacattgaagaaaacttaggcactgctggtttagaaaaagttgctgtacaactaattttttctacatggtagatagctatagttgtcatagtttcataaaatacgaattcctttttaaagcagtaaagcaactc

SEQ ID NO: 16305 - DNA, 1154 bp, Homo sapiens
gttatttctactctcccctctcacaggccctggtaaccacaaatctactttttgtctctatgtttttgcctcttctggcaatttcatataagtggaattctaaaatatatgttttctttgtcaggcttatttcacttaatataatgttttcgagattcatcagtgctgtagcatgtatcagtacttcatttctttttatggataaatacttttccattgtttggaaataccacattttgtttattcatcaactcatggaaatttatattgatttcactttttggctgttacgaattatgctgatatgagcatttgaatacaagtttttgtgtgggcataagttttcggtgcccacatttcctcaaaaagacatatagttgcagtatgacccagttatgccatagtattttccaaagtgggtgtaccagtttacattcctaccagcaatgtatcagggtttgcattcctccacatcctttccaacgcttgttactgtttgtctgttatgtcatagctatcctacatggtgtaaagtgacaaatagcttattgttttttatgaggacttatgtaacagtttaaaaatcttgtcttttaggtgctgtacttctttgcagtatacaaggactagcagttaatattgacccaatcttatatacgtggctcatctatcagcctcagaaacgaacaagtagacatatgcaacaggtaagagatttttaaataattttttctgttaacaaatatttttcttattcatttagtagaattatatatgtcttttgatggattcttttttaacaaatgtactagatttcctttgtctccccaccttacccctttcaaacaattccgttcccttatttttgtatgagaaattgcatgtcagtataaagtttctttgattattaaaggggctttctgtacaatggcttacaaaacagaaactagtttaggagtcctatttcaccagtcttcattctttcatagtgtctacatgtccattctcatggtgtgcaatacataagaattgctcagtaaatgaatgttggcttgtttgttttgttttgagacacagtttcactctgcctcccaggctgaagtgcagtggcgtgatctcggcccactccctggttcaagtgattctctcgggac

SEQ ID NO: 16306 - DNA, 1178 bp, Homo sapiens
tgagcatgcattttataatcagaagatgttaataggctaatttaaatttgttagatttttaccatttttaagattatgtttaaaaacctgtatgagagaacatatttggagacaggaacaaaaatatggcttggaacagaaacagtatgtggctataagggttaatggcaggggggtgggggcggtggtgggcatagaattgagaaggaaaaaagcagaatttgttcaatgcacacaagcaatgagagtaaggtgtggtatgcccaaaatggaaaagaggctattcagagtggtcagggagcttagaggagcgtaaaggagagtgaaacttggagtccaggtagcctgaactgtgctttttctgtggctgagggtgagtgatcaaggtgtgaagtctactagtaggaatagacctcagttgatcctcaaagatggtgagtattgagagagtgtttatctctaacttagcctttgtgtttctcttcacagaatttcttcaggttgaattacctagaagtttgtcactgacttgtgttcctgaactatgacacatgaatatgtgggctaagaaatagttcctcttgataaataaacaattaacaaatactttggacagtaagtctttctcagttcttaatgataatgcagggcacttactagcataagaattggtttgggatttaactgtttatgaagctaacttgatttccgtgttttgttaaaatttcattgttctagcacatctttaactgtgatagtttgtccgtttcattgcagttacttggtcttgggctatggattaaaaagtgttcttcatgagcctgtaagactactgtactgtgggctctaagaagagatagaatcctaataaaatctatccttggccttcattgccactatttggtagctgtgccaccaccacatagttgaaataggtaattcaaatgtagggtttcttactcagtattgctttattaataacaagctaacagtatgtaatagaatttggatatatatctaatccagaaaaggttacttaactagaattgagtaatgtctcctaatgacaagcagagtatggtactttttcagaggtcttcttaggactttaattcatgtttattgcgagcaaagtgatactggagaactttaaaaaatgacacttattcaaagctaat

SEQ ID NO: 16307 - DNA, 1137 bp, Homo sapiens
cagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggtt

SEQ ID NO: 16308 - DNA, 3729 bp, Homo sapiens
acacctctatgtaatcccagcacttcaggaggccaaggcaggtggatcacttgaggtcaggagtttgagaccagcctggtcaacagggtgaaaccccagctctaaaaatataaagattagccaggcttggtggcacatgcctgtaatcccagctactggggaggctgaggcaggaaagttgcttgaatccggaggcggaggttgcagcgagccaagattgtgccgttgcattccagcctgggcgacaaagtgagactccatctcaaaaagaaaaaaaatgtatctgtgatacatagtatataataactactttggcttctttctaattcgctcactcaacttctccacctcatgtttcgatggaagtctaccacttcagcagatgtccattgatgactatttgtatttgccatctttttctgtgctttaaacttaagagttctcattttctgtctagcctgctgttcatgtacaaggtcaggaacctttgactgcttccatgttggcatctgcccctcctcaagagcaaaagcaaatgttgggtgagtacttctgtcccaccttgtcagttcagaaagactagaaaatataggaatcacttaggcactaggtcaatcaattgacagctagggcagtggaattgatctgaattggcatgaatgattatgatagtacagttggtctgcctaattaaaaccactggaaagccaataagaaaatgtattgttagtaataaatagggtagtagggcattactcaccatgggccctcactacatttttgagagaaggaatttgaagcaaatgagaagaaaacttgtgactttgcctgaacaccgatttaacaacctaatggtaacattgcttaattggcaagctgataatatcaagagttaattgccttgtggcagattttattctgtcttcccatgaagacataatgaaattgtggattatgggttattatatacgtgagacagaagtatggttcttaaaccccagtttaatgtggtaattcaatgcagttaaaaacttttttttattgaagggagtttttgaatgtttctgttcctaggtgaacggctgtttcctcttattcaagccatgcaccctactcttgctggtaaaatcactggcatgttgttggagattgataattcagaacttcttcatatgctcgagtctccagagtcactccgttctaaggtgatttaaatttatttaccaagttgcctcttacacagttattacgtggctttttatggggacttaattgtacagaacacttacatcgtgttatatataagccatgtacagttgtaaagtctgcataataacctgtggcgctatttatccccattttatagataggtaaactgaaacaggctgaataatttgccaaatgctcacacagctcttaagtggcagagcctggcttcaaatcccatcagctccaacagccatactctcaactgctgctgctttctctagtggagaaagagaaatatttttcgagtgtggggaggacaaggaaagagtagtgcaggggagcgattcataattctagaatagtggtgtaatagaactcaaaattgaatggatatagttgtttagtgtaacaatttatactttcatttgagggaagaaacttatctttgttgggaattggtatgttaccattatgaaactctttatttccattcctttcctgaaccagtttatctgttttccccttttttaggttgatgaagctgtagctgtactacaagcccaccaagctaaagaggctgcccagaaagcagttaacagtgccaccggtgttccaactgtttaaagtgagcttttccctctggtttgttgttttaagcttgttttcttcatcttttataaagtttgttgagcatattttgaaatgtacatagcaaaagatcattttacagttcatttaaatgtattgctaatttttcaaggaaaagtggaactaactatagaggaattaaaggaattttacccgttaactgttggatttttaaaatcccaggactttcaggtggtgtttttttttttttttttttttgagatggagtttcgttctgtcgcccaacctggagtgcattgacgcgatctcggctcactgcaacctccacctcccaggttcaagcaattctcctgcctcggcctcccgagcagctgggattaacaggcccatgcctgccaccgtgcccagctaatttttgtatttttactagacttggggttttgccatgttggccaggctggtctggaacttctgacctcaagtgatccgcccacctcggcctcccaaagtcttgaaattacaggcgtgagccactgcgccctgccagattttgtatagtaatatatatataaaatgacctgtcacaggttggctttcatagttttacctttcctttttgggtggtgcccttgggtctctactactgtctttcatcactcccaagaaattgagtagtgcagccaggatcaggaccagggattggcaaatgttttttgtaaagggccagataggaaatattttgggctttgaggactgtgttatctctgaaatgatcttgttccagtgttaccatgtcaagacaaccatagatagtatgtatacaaatgaacaggtatggctgtgttccagtaaaactatggataaaaacaaccacattgcatttggctaagggctttaatttgctactgacaagtgatagtcctggtcttaatttgtttttttaacatttacagattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtgcacggatttgctttttttcaaagtctttataattgccatgcataaataggtaatatcttaatggtgctgagccgacataagaatcttttatgaaaaatgtactgttaagttcagggggtctattggttttatgtaaaaggcacaagacaattcctgtagtgcattttatgagttaaggtttccatacggattattgaaacaatttgttacatgtatttgttacatgatcttaatatttcatgtacaagactgacacccatccacttttgaagataagccagtttatggggtttttttttttgcgggtagaggttgggtctccctattttgtccaggctggtctcgaattcctgggctcaagcataagcataaggcttattcctgcataagccaccatgcctggcctgccagttgatgattatattgaggtttctaggctatgagattattagcttaaacccttacatgatataaaacaatgatagctactcttgaagaggatgtagataagata

SEQ ID NO: 16309 - DNA, 1099 bp, Homo sapiens
tgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctacatataagtactcgtccttgtatgaattaatgtttttacttattgatgctctgagtctgggaaaatggcaagtgttaagactcagctttaaaaagttttgtcactttttagtcttttatgcaaacctcagatcgaagaagacagcataaacacttttcactcagtaagttttcccagttaatgtatattcacatctttaaaatgcagcattccaaaatatgcccggtgctatccgcccagctgctcctagaccaccatttagtactatgagaccagcttcttcacaggttccacgagtcatgtcaacacagcgtgttggtgagtcttaatccttcctttaaaaattgatcaccaatttgaaagagcaagataaaaatacaaaatgttcttattttttagctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacaggtatggatttaatgatttcttaataaaaatcacatttcttgggtgaaatcaaaggtgtgaagacagctgggcacagtggctcacacctataaccccagcactttgggaggttgaggcaggcagattgcttgagaccaggagtttgggaccagcctgggcaacatacaggaccctgtctccacaaagaaaactagctgggtgtggtggcataagcctgt

SEQ ID NO: 16310 - DNA, 1181 bp, Homo sapiens
cagcttgaattgttagaatagtcaaaatttaattgggaaatgcttccagtggtgcccaaaagtcaatttagtaggcctgggatgtatttatttagataattaaatttcaatattgaaaatccaatcaaattcagtatctaaaatctttaaaagtttctgtgcagccttcacttctgtcagttctctgacctggctagggtaatgcatatgtgtagtttgcccttaataattgggtattaaggaaaaattgtgaactcaatgggtaaatacaagatgattaagcattaacagggtttagttatttgattcagtgatttataattgtctaaattgtaacgctctttttttgctcctcattctaccattacgttaactttttttttcttttttttaataggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacaggtaggttttagaaggcaaccagaaccatgaaggttttcgtatttggtcatttctagtgttttttgtgcccctcgccccgcaaatgtgaaacattaagaaaggggaattatgattgagtaggaaaaaatgcttgagtgtgaagtcctggtaaatgttttgaaaaagtacatataatttattgcattatttgcttttttcttcaactgataaactcatgtgctttttttccctgcagactcagaaccgtgctgcatactatcctcctagccaaattgctcaactaagaccaagtcctcgctggactgctcagggtgccagacctcatcgtaagtcttttttcttttaattaaggttggggattgagttaaaaataacacattgggtaaatcagctcttctatgtcaatgttaggttaactattgcatttcacataatttgtggttatggatgttcatttttatagcatttaaaagcagtgctaagatagtaatgtctacagtggtttgatttc

SEQ ID NO: 16311 - DNA, 1751 bp, Homo sapiens
cagatacttggtaagttgaggcaggaggatcacttgagcccaggagttgagttaaagtgagcttattcattgtgctgctacacttcagcctgggcaatggaatgatatactgtctctatagaaaagggaaaaaatcaaattattgggtaaaaaatgcaactcttttgtgctagagctgagaataaaactttttacagccgtttaaagtgtacctccttaaatggaaggaggaatccttcaggggagggaaggtgtttaccttcttaataataaaaggtctttcaatggaaaagtatacctacctggggcatagaaggctgggagggaggagtcaagttacggagctttgaaatttttttcatggctttgtatgttgaaatttgaaatgtataacgtgaatgttgtatggaatatctttgatttatgtaaaaaaattttttagggcctgccttaagtgtgaaagtaatgactgatgaaagtggaaaatccaaaggatttggatttgtaagctttgaaaggcatgaagatgcacagaaagtaagtggtctgtattcagcaggaagaagggggtacaaagttgagttgctcttgtgttgaagtctatgtgcatactaatagctatttgacatgttcttatattttcagttatttgcattttatgcattaggtttgagagtataaattggtaacctatattgtcccaaaaccttgagattttgggatgggtttgtctttagcttttgtgacttaacaaatttgtcttaactgttaaggaaatgaactgtaagttgaaagttttgtgattttttttttttctttttttttggggggaaggctgtggatgagatgaacggaaaggagctcaatggaaaacaaatttatgttggtcgagctcagaaaaaggtggaacggcagacggaacttaagcgcaaatttgaacagatgaaacaagataggatcaccagataccaggttcatttttaattgaacaaccaaaataagacagggatgaggaaacctattttacgttgatttcagttacttccaggtagctggagggtttgagaggggaataggagaagaaatatggggtaaaataatagacccgatgtacttaggtaccaccatggttttctttttctatagttttcttttcttctttttagggtgttaatctttatgtgaaaaatcttgatgatggtattgatgatgaacgtctccggaaagagttttctccatttggtacaatcactagtgcaaaggtaagaaaacatatggttcatttatttgaggtctagtaaaaattcatacatgtagatatatgtatataaattttgtattattatagccactagagaggtgtttgcttcgttacttctaaaacttaaattcacatttgaactggttgtcatagcctaatggttaacttaaaaatggcaagcactgaactctttgctaaggaaggctgatatcctcacatgatatgcactattccaacaactagtcattttgctaaagcaagcaatttattagggacttataattgttactatagttctgatctgtttattcatttctacaattcattctgggtagtcaagccccagttccctcccctgccccctagcagtaagaatagagatcatattttcttttatttgaaatcagagattaagaaacaaagcagtagtattctagtacaaattctgaaatcttgatttaagaagttctcttctagatgtttttgtcta

SEQ ID NO: 16312 - DNA, 1133 bp, Homo sapiens
gccactgcctagcccagtgatccttgttctgaattactactgttatattcagaaaaaattaagttttagtgtcattttgttgaaaatgctgcagttatgtcaggctgttgtgtgttagagtacacgattgggaagtttaaatttttattctaggagatggcaaagaaagcgcaagcgccactttaaaatgacgatgaaagctttttaatttgatagaggtctttttattggcatggtacacatgcacttccactcatttgtattgatgggagtgatccctttaaccctaggttagctagagaagagaagtgtgtattaaaagaagtggttttttttttgtgattgtagttagaggcttattcatatatttcatggtgtcatatcttaaattatggccctatttctattttgtagtgtgctttttattagggattctgaatattctcattaacagtaacaaaaccaaccatcaggcttacttaatctgaactttataaaatagaatctaatgttatagtccttgtatatcttattagatttgttggacgatttaagtctcgtaaagaacgagaagctgaacttggagctagggcaaaagaattcaccaatgtttacatcaagaattttggagaagacatggatgatgagcgccttaaggatctctttggcaagtttggtaatgtgtcttaattaaatttttacacacaaagctctgaattagtgctcagtgttaattttagctattactttatactaaaaaagtcaataaaattagacttacatggtactttaaaatatttgtggttatttgaattaagctgctggccatctattacactacaaagtagtataatgcaaataaatagaattctatccaggttaaaggttaatagcattagattagcacagtaaggtatgactaagtaattagaacagattttaaaatattttactacattaagaggctggagatatatatgtgtgtgtgtgtgtgtgtgtgtgtgtgtgtgtgtgtaattagagatcccatgtcatcagaagcatatatttgacacagccagcctacagtggaatgcagtctcatagaacaataaagctggtcagtctaagtaacatcatgtttgagcagttta

SEQ ID NO: 16313 - DNA, 1510 bp, Homo sapiens
ttagttattagcaatgaaatgaccaattttagcaagtagttgggaagaagttaaaatatttaaatctataaactacttccagcttgtagataaatctgttgcgtaatgtcttttatactgcttattaaacagattgtatgtgaaggaatttggattttgataactaggaaaaaaagtgctttagatttaatggcaattaaggcgagagattgcgtcaagaatttattaattattagcaatatggaattcttttatatgtgagaaatttcgggggcttctggtatttgtctttgctttatacaacttaggtcccacactagtgtgtgatacttgaaaggtctagccatcttgaagcttaaagaggaagcgttcaactgtgagaccatgtgtcctcccactccagtcaccatagtttatataatcttaagtagccagcaaaaattttgaagtaatattgactctgaaaatgtccttcctgcagcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtaagccaaaaatgtccgatacacatgtttacattgttgagctacatttagtttagtgcttgaaataggaactgtgcagtaatggatatctttatttcacaaatatccaggttagatggctaacagattgtctctcaacactgaacaaatgttaaatcaatagcaaataaagaaaaatgggtatatgtttttccctaggtggtttgtgatgaaaatggttccaagggctatggatttgtacactttgagacgcaggaagcagctgaaagagctattgaaaaaatgaatggaatgctcctaaatgatcgcaaagtgtaagttataaatatctagctaatcatattttgaatcttatttttaataattccaaatccattcattttaagttaatatttgtcagggagaagttagatgcacataagataaaagaataaaaacattttaaagatgaataacaaaaattcatgtagttgtactggagtgaaaattaataagctaatcttgatttttacaattgaattttctacacagtaagtgtaacatacaaataacaggtttaatataattaacattcatgccaaaaggaaaacagaagataagtaaacagaaaaatgtagctttttcaaaatgagtgcattagtgaaaaatcaggaattcagacaaacctaatattcataattcttgaggtactggttaaattaacccattttataggtgaggaaactcaaagtaatttgcttttatgtactgtaaaatgagagacatacattactcacaagtccgggcgcggtggctcatgcctgtaaatcccagcactttgggaggccgaggtggg

SEQ ID NO: 16314 - DNA, 1121 bp, Homo sapiens
aaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacggtgagcgccgggctccgcggtcggccgggcgggcgggcggccatgaggctcgggcggcggcggcgggcggggtaggccggcgggcccggggaggggggcgggagggcatgtcaccccgcgacggccggcgggaaggcgccggggtccctggagccgcgtttcccgagccggcggggacccgcgctgccggcagccacacgcccggctacttcctcctttgcgaccattttctcggcctcagacgctctcaaactttagggtgatgacgcgccgggagggtgggtgagattcggttcctccgcggcgctcccgccagtggccccgggattctggggcgttgaacgctgagctccttccgtgggtaagaggtggaggcgctcccaccacccggagctcctgccggcgccccagcctggggaggaagtgcagttctgtgctcgaaaaataccacgtgttgaaccctgtaacctcgcaggcccgaggcctgcttctgctcctgctcctggcc

SEQ ID NO: 16315 - DNA, 2576 bp, Homo sapiens
ttgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctgcatctagggcaacaatccttttccctcgcagctctttcttttacctcacttactgatttctcctgacccccaagccaaggaggtaaaataattatatatatatatatatatatatatatatatatataaagtaattatattttatagctagactgaagaggtgggaatttttttgttgttttttttttttttggagacaagagtcttgctctgtcacccaggcttgagtgcagtggtgcgatctcggctgagtgcaacctccgcctgctgggttcaagcgattctcctgcctcagcctcccaagtagctgggattacaggtgcccgccaccacacctggctaatttttgtgtttttagta

SEQ ID NO: 16316 - DNA, 2389 bp, Homo sapiens
cctctaaaaacaatgtacaccaatgttcctgagcacctctttacaattagtttacttatagtacttagcagaggttcttttttttctcccccaacctatccccttagcaaagcttctgagtattaaaatatagggcaaaatgtagatgtagatatgtgctatataaatttgtttataaatttgttggttgaaagttatcactttacacattacatttggttggattttttccccctaaatagtggagttggtggtgggtgtgttgtgtgtttcagaattctttctttttaaaataaattcttcagagttctgtatataaagtcgagttgacaagtttaccagatattatcttcatagtgtttcttcttagttatttgaaatgcatgtaagttgcatttgtgcaatggtaacattcattgaaaattttgcttatgttttataggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttaggttctaatgtatatgccgtaatgaaataatcattaagcctattgtttaatgcaaaatatggaacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccctcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttttcgtttgttttagtgactaattcaggatgaaagtttttttgttcttgtatttaacccttttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattcttta

SEQ ID NO: 16317 - DNA, 1589 bp, Homo sapiens
atttgcattattttgctccttaatgcaaaataactttttaagataacctgtgtgagttttgaacctaagaccgtatcttttgtttggcagccttttttccactaatagacactttatggaattagctgcaagaaaggctcttagaaaccatttagtccaacagcctcatgttacagatgaaaatactgaggctctgtgacagaaagtcacctttttttcctctactaactctagacttactcctttggggaaaaaaaacaaaaacaaaaacctgtcttgaggtatgaatgatccctttcctttttagtacaagaaaatatatttaaaatccagttcaaaataatatctccttttaggttattaacataacaatagggctttgtgtatatactgccagagttaagagttaaatattaacctgttaaattcctgttcaggtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaag

SEQ ID NO: 16318 - DNA, 1153 bp, Homo sapiens
ataaatcatggctgggcacttcctaaatttggtaaaagacatagatttccagattcaagagtcagtgaactcaacagaataaactgaaagaaaactatgtccagatacattataatcaaacttctgtaaaataaagaaatgttattgaaagcagccaaagaatggttctttacctatagggaaacagtgatttgaaagagtggatttctcactataaagtatgaaagccaaaagtcaacaaactcatcaaagtgatgacagaattctgtatccagtgaaaagaattttcaggcaataaagtgaaagaagcttatccgagtttcattaaatgactttattttaacaacagagacgttaaagacctaataatacacaagctttgtgtgtcacattctgaaagggcaaattaaaagttcatttacctttaatattgttatacacatatatttaaatatttatgttgctcttcctacctgacttcatttgaatgatttgagagaaccatttcatatgttttgttttttcagtgaatcttggggcttactctctgatattctctgttagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggtaaaagaactttaatcttgggtttgaattttttaaaacatttcaatttatgagattttctaaaatatatttgttttaaaatgtatgtacgctgggtgcggtggctcacacctgtaatctcagcactttgggagactgaactgggaggatcacttgagcccaggagttggagacctgcctgggcaacatggcgaaaccctgtctttactaaaaataaaaaaatactagcgggcattgtgctgcaatgcctgtagtcccagctacttgggaggctggcgtaggaggatgacctgactgtggcactgcacttcagcctgggttgacagagtgagaccctgtctcaaaaacaaaacattctcaggctggtgttcctgtttttttttgttttgttttgttttttgaaaaagtgt

SEQ ID NO: 16319 - DNA, 1173 bp, Homo sapiens
tttcactttctataatgttataatgagaagaaattaggagatgtgaatgaggaaactgggaagtcttaacatttccaaactatctgttttgtacacttataggaaaccatactctggcttgggcttaggaatttaaaaataataataggtaatattctggtggcctttaatgctttcatgccaaaaactaagaacagaggatatttaaatgagtctagtcatgtaagaaatttcagcgttatttatagtgacactatcataaccttacttgctatatattatttcacagctttgacatgacaagggagaaaattgattaacaaatattgagtgaacatctatttcgtgccaggtatattctacacaatcacctccaaccctgaaaacccatagggagagaaaggcattaacaacacagatgctagggaaggataatctttagctgtcatgttttcttacatttgtctcatttctttgcattgactttgaaatttaaggtagttgaatttgcattcatctaaatacagtatatttctgattttcttctaggtttaatgcagagattaaggaaccgaggagagagagaccgggaaagggagagagaaagggaaatgaggaggagtagtggtttgcgagcaggttctcggagggaccgggataggtaaattttgtatctttgattcaataccacctttttggatgaattagagataggcctgtaaatgaaagaatcttaattatggattattttttagaaaagtaaagttttaattttgaacatatgtatagtaactaagaatagtctgttaataaaatacaataactaagaatagtctattaactaataaaaagttctgctttaaaaacccagaggcggttgaaattatattctttttatctgactcaagttcctatttgaatttttttacccatatcattctctcctaagtttatcttaaaaagtcttcatttttcaggccacatgcggtggctcacgcctgtaattccagcactttgggaggccgaggtgggtggatcatctgagttcaggagttcaagaccagcctgaccaacatggtgaaactctgtctttcctaaaaacaaaaaattagccaggtgtggtggcgcatgcctgtaatcccagctacttgggaggctgaggcaggagaatcc

SEQ ID NO: 16320 - DNA, 1113 bp, Homo sapiens
aagtcagggcattagggaaagagatgttactactgaaaaaaaatcaggagaactgtcattgtggtgaagaagccatattaagttttaaccatgctgagtttgaattgagcatcgttgacgtggacatatttatttaacaaatggagattctggttcatggtgaaagtttgaactagaggtggatctgggagtcacctaaatggagatagacattggactttaaggagaggaggtaaaatgaaagacgaagataagacatagcccagggatttatccgtatgtagaatacagaaggaataagggaggaaaaataataagttgtcgggaacaagtagctatggaaaagttctctgttaggacacagtttgaagaagttaagacctcagaatattttttaaaaaaagtaagttactaccattgaacaaaaaccaatcagtctttgaaattggctaaattatttctcccccccaccccttcccttaaacttcttacaggccacagtgtagctttatgggaatggttatttcccatgatatgctgctaggacgttggcgcctttctttagaactgttcggcagggtattcatggaagatgttggagcagaacctggatcagtatgtattttgtgcaccttaaattccattctgcctgataagcatgtatttcagggaataatctgtcatgcatttttttttttttaagatcctaactgaattgggtggttttgaggtaaaagaatcaaaattccgcagagaaatggaaaaactgagaaaccagcagtcaagagatttgtcactagaggtaaaggtatttagattttcttatactatacctgtagtatgctatttatataaattttaaaacatgcaaaataacaatagctttgcttagggatatgtacttataattaaaaatttaaagaaaataaaaagaaatgttaactaccaaatttattttttcgtgtgtgtgtgtgtgtgtgtgtgtggtttctttttatttttttcttattgtaaccaccaaatttagaatagtagttttctctggcagtttggttccctagcatcctctatgaatttttttgttttagtttttaagtatcattatgcatgcat

SEQ ID NO: 16321 - DNA, 1432 bp, Homo sapiens
caaacaaggtactgccaaagttttattccattaaggagatttggtgctagtgtgctgacttactattgagatatgtaaattgctcagacattactctgcttagcaaatgctcaggtttcagttcctgatcatctcctctgtttggatttgtcagtgagttgggtcctgagtatactcatgaatctaactgtatttgggtggtgggtatctcaaaagataaagaggaggatatgggaaacctttgtccaatacaaaatggcacaatattattaaatgctgatttttattttgcattttttattgtaacatacacataacgtaaaatttgcacataacataaaacttacattgtaaccatattaaactgttacatttactttaaaaaataccagaattttggactatgaacttgtttttgtgtggcattaaaattttataaaagaggtagtaggaattttggattgagcaggttaaaggtctgttaccctaatccagtaattaaataattttcctaaaaaacaaaacattttatctttttatgtttaggtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcaggtgaattaaacaagttagtcttaaggtttctttctaattgggtttattttctttaaagtattcaatgtaactagaatatttctgttaaaattccagccaaatgctagaaaggaggatctttttggccgtccaagtcagggtctttattcttcatctgccagtagtgggaaatgtttaatggaggttacagtggatagaaactgcctagaggtaagacagtaaaagtttttttgcaatataacatttattaaggacaacttgtcccagcatatagatttttagaaatgcgttaattcagaatattatattttctgaaatgaagtgtcagaaattcctgccttgtggtataatgtaggaagaattccaacactgtcattaacttgctgtcagatcacttcatccataaaataccagcctccatatgtgctttgtctgtttcacagagctgactgctgtatgtggctgaaaatttgaatttttcatgtataataaaaatatatagatgagcatgtgtaattttggctacaacttttacttgctgaactaattttaatcaagactgtagataaatagcattaataatgatacctaatatttgttgactaattctgtttcctgggcattggtctccatctttataactatgtttggtagaatgcattatcaccctgattttttgggtgagaaatagagtcttgaagagagtaagtaaa

SEQ ID NO: 16322 - DNA, 1148 bp, Homo sapiens
tcaacctcacctaagagctatttagaaatgcaaatcctggggctttaccccagacctactaaaactctggggattagaccagaggtctgttttaataagccctccaggtgactttgatggaccctgaagtttgagaatcactgtcttcagggaaagaattcattttgccattccaaaggatactggaattccttttctatacaaagtataaggctgtaaatcatgcacagtggttatatttctaaagctgagcagcaggcttaactactttgtatttatgaatattctcagctcctaattttgcatatttatgatagtgaatttcacatttgtattcttctaataaacattttcctttctgttcttatagacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggtatccattcttgccatgaggttgatttaagaaatacttgcttggtatggtcttctttagtacattgtcaacatttggagtaaggagaatagcattgcaaaagagaactagcacaggaccatttcatataggaaagtgggcttgaatttatccaacctttccccattgccactcttcacttaaaataggaaacctaagaatctggttaaacttcatgcttgagatagtttggcctggcctgattatcatctttattttttccttttttttttttttttttaaagagacagagtctgactctgtcacccaggctggaatgtgatggtgcgatcaaagctcactgcaaccttgaattcacgggctcaagtaatcttcctgccttagccttctaagtatataggacttacaggcgtgtgctaccatgcctggctaatttcttaatgttttggagagacagtgtctcatgatgttccccaggctggccttcaactcctggcctaagtgatccccctgccttagtctcccaaagtgttgggattacaggcat

SEQ ID NO: 16323 - DNA, 1408 bp, Homo sapiens
gtgcattgtgggatgttaggcagcatccctagcctacacccactagatgccagtgaaacccctctcacccttcttcccctccccttggctcccacagttgtgataaccaagaatgtctgtagatactgccaaatgtgtagcccctttggcggggggaggtggcgtgggggtcagatttcccctggttgagaactttatattaattcttgtcccctccatactcctctccccaaaatagtgtggtttaggcaaagttttttgcttgggtaccacaattgaccatttagatttacgtaagtatatataatcccagagaaacacaattagcaactgacattagctcattgtggttgtcctttttccttatagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacaggtatgaaaccactgaaaagtttcccattccactatttttttttggctgtcaattatgagaattccagtattaggggaattaaatgttagaaacgtttacatattgacatactgctgctgtatcgaatttagctctatttggatagttttaactattttagtttggtcttcatagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacggtatgaaattcttcatatatacagaacgtccccaacttaaaatggatcctcaacttacaattttttgtttgtttgtttgtttgtttttttgagacggagtctcacactcttacccaggctggagtgcagtggtgccgtctcggctcactgcaagctccgcctcctgggttcatgccattctcctgccccagcctcccgagtagctgggactacaggcacttgccacccacgcccggctaattttttgttttcttagtagagacggggtttcactgtgttagccatggtggtcttgatctcctgaccttgtgatctgcccaccctggcctcccaaagtgctgggattacaggcgtgagccacagcgcccgacccccaacttacat

SEQ ID NO: 16324 - DNA, 1304 bp, Homo sapiens
gactgtgggacaaaaaataagaaatcgtacatttaggactcactgtatgtcaagcacattggcaggtatatttcataaactgaccttgtaaatgttttggttaaatttgttttgagattttattataaaatgttaatacttaaaaaatgttagaacttataactttatgaatgtctaaacatcttatgaagtatcttaacattaatagagtgaatataattttttaaagcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaagtaaggcatcctttttgattttggtttagataccattttcactctgtttttgtgatagtgatttatgtatatgaaaagatagattgctgatatttctctttttgttctagcaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcaggtaaattgctaccaggtaacagattctgattaatccttctctggaaatgtcgtgtttgacttcctaaaacctttgcataagcactcaggtggtgtacatgatcatttgtgtaacataaataacaaccagaaagccggaattttaaatatttttctacaacaactgtattatcaaggacagggctaaaataactccattataaatgtttctaattataagattatttgttcttaagtttcatttatcttttctatttgtttgatagtttccctaattacactgtaagcttgttgaatcaggatgttgagcaacttaaaactttccgatgtcctttagcacactgcttctcaaactttaatatgtatgaaaatgacttggggctcttattaaaatatagatgcccactctagaggtcttgaggtggggcctccaacttcgtatgcctttcaagttctcaggtgatgccaattctgctggtttaggggtcagacttttcagtaataatgctgtagatctttggcaaatatttagtgtattttgttttttcaagtctgattttataac

SEQ ID NO: 16325 - DNA, 1191 bp, Homo sapiens
tgaaaaattttaatagatattaaaagaattctggttggtattttttgttttccttattttaagtacctaaaggtgtgataatctgttgttattgattgttttccaagtgtactagatgccagggtggtggtgaatagtcctgacagtgttcacatccctatcagaagcaagaaatatctgcccatagggttacagggttcattaggtcatataggaggaccacttgaacaggactgggaattagggaagagattccaaaagtgattgtaccttagagtacctcttctcataggaattctgtgttgctttatagatgtcattactaccaagtaatccttcttgttatataagctttgacagttatactttgcatttagaaattaacaagggctctctctggtttcagtgagttataccttcataatgtcaacataaacctttgtatgtttaaaaaatttcagtttttgtacttgtgtataaattctctatagactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggcaagtgggatttttagaacatacagtaagttaaatcaaaagagcgcagcacagctgagtagcttttcagcctccctcctcacgacaacattctgttttgcaggggagagcacctcttactattcttagtacagacagtcgcaaggcagacggtggagcattgtcaatacaggccacctcgaatcagggaagatcgtaaccgaaaaacagccagtcctgaaggtgagttaattagacatttatgacacttgtgggaagcaatatgttttatttttgttttggtcactatttctttttcattttagattcagatatgccagatcatgatttagagcctccaagatttgcccagcttgcattggagcgtgttctacaggactggaatgccttgaaatctatgattatgtttgggtcgcaggagaataaagacccgtacgtattcattaaaacctttttagatttatgtatttcctacgttagtgtagaccttttacagttcattctgtctttcgtttctcctcaagtcttagtgccagcagtagaataggccatc

SEQ ID NO: 16326 - DNA, 1103 bp, Homo sapiens
acattttcctgtattaatcatatctttgtgtcttttttcgctatgactatcactagacttacagttttcagctttggaattaagtctgatatgaagaaagttgatttaattcctaagtaaatgaggcaaaagagctgattgctcagttaaatatggcataccatgaaaattggaaattttcactgggtagtataatctgatccacaaatcttgatacagattttataactacaatgcctttttggggatgatacaaattatttttttctactggtaatatttctatttgtatatcataaactgtatatttgctgtagccctttataagttctagttttccaaagcacattaattttgtttgttgagattgaattgttctagaaaataccagaaataattattatgatgagatatatgcatacttataattattcctttaaaagtacactcttaattttaggatatttttgagtgtcgaacttgtggcttgctggagtcactgtgttgttgtacggaatgtgcaagggtttgtcataaaggtcatgattgcaagtgagtacaattctagttttctttagtttaatattataagctgtttagatttatattgctgtatggaaataatctgtactaagtcatgttttacttcagaaagcatgaggttacttacgtttcccttgtttaagtcagtttatgtataatagtgtgattcttgatttaaagtatactgtgaaatgtttggtttctttgctagttcaaacattgccctccttaaataaaagtaggtgattatacattgtaactaggatcagattagtcttttgagaagtatatctacagaatgttcctgagtgtattatgcagcggaggtctcaggtcccctgtagtggggtatactaggagaaaattgccataggcctagagggaatcatggtgaatgtttagactgtgtcttaaactaaatgcaacagtctttcattcagcaacagttaccacagctagttctgttggttttcagagacctgagaagcaatgaaatacctagcactaacatctgtggtgttttaggattatggatagggacttcagtataaatggctaca

SEQ ID NO: 16327 - DNA, 1192 bp, Homo sapiens
tgccatagtgagctgtgttcacatcaccgcactacagcctggaagacagagtgagacactgtctcacacacacacaaaagcctaagaaggtgggagtaagcctggaataaaatttatatcctttgcttaattggctatcattattaaaagggttctaattagatagataacatgaagtaaaaaccaaggattggcagactatggcccaaaggccgaatccagccactcctattcatttatgcattgtatgtggctgctttcctgtttcagttgcagagctgagttagttgagaaagctaaaaatatttacttgtccttaacagaaagtttaccctcccttctctattcctgtcgattgtatgttctgcttaaagtgtacccttaagttctgtttcttttggtaggccacctgaaattgtctctactgatttgcaaatctgattatatattattgtgttggccatgagaaatttttaatatatgtaatgtgctactcaaattcattgaggtttttttcccctaatttgtctgagcacagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagagggtgagattaagaactatagcaaggtctttaaagggagttttaggcaattttgaaaatgtaacagttgttaaagaaaagcaaatcactataaagaatttgtgtgtccttttttttttttttttactttctcagaaggtaaagatgggtatgtaagaaaaaaaattttgcaccagtgtgtttttattgtgtttaatactatatgatatatacaaactggatatgtaatgctaaatgaactttactgattttataattgcagatgacttattacatgagaattatttagcaggttaagccaagttacattgaggcaacttttatctaaatttttagaatgtagaggagaaaaatcacttagtgaggtgttatatgtttttggaaggtaaataagctttttttgccataaagtttttaattggctaaatgaagggagaaattgagga

SEQ ID NO: 16328 - DNA, 1750 bp, Homo sapiens
gttgagtgtattgtagccactagctgtatatgtggctgtttaaatttgttaaaatcaaataacttaaaaaagtcagcaccttcgtcacattagcttcatttcaagtgctcagtagccacttatggctaatggctgccgtattggacaccgccaatatagaacgttgccattttcaagaaagttctgtcagaccgaaggctgctttaatttaattaggagatgggaggatttcacgggctatatacttaagtttttcagttgattactgaaaacattcactgactgtaatcactggctgtgtgggtcagttttctctagcaaatgagccttgaatatagatgtcagtagcaaagctcagagtctgtctgggttgattttataacttggtgatcattgaagaaacatacaaagaattggattcctttaacattaaattagttcagtgaatagaatttgtatgttgattttatataagctattgctaatgttcattgaatttgcctatacttccaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggtaagtgtaaagaagttattcagcaagtgaatattggaactgactccgtgagtttattatggagtttgaaagcaaaattccttttgtgtcatgcaggttgtcaaaactggtggaacaccgaaggttcccgactgtttccaaaggactcctaaaaagctttgtatacctgaaaaaacagaaatattagcagtgaatgtagattccaaaggtaaattttgaaacttcttcagctggcatatcctatattccattaatacttgttcaggaaatgggaatatgataaaataattcagggcattggcatttttttgttccctatctgtaacattatggaatggcatgtatctgtttgaattgacttacaagtgtggccagagaagttaaaatattgtagatgtttattagagataagatgtataacaatttttcttctcatttatgtgcttctgaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggtagaggctcatttttgcttttgaaaagtgataggacaacaatggcatttttgtgaggttagggggtctggctctggttagcttatcaattattcaaaaacctagaatatttagcacatttgaatactaggtttcttattactattactaaaatctaatttggaaataaatatgcctgtaaaaatcagatacattttttgattaggagtcaaactttaccattttcccattattataggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagaggtaatttgagtattgaaactactgggcattttaattcacaaaacaccact

SEQ ID NO: 16329 - DNA, 1135 bp, Homo sapiens
gctggagtgcagtggcatgatcttggctcactgcaacctccgcctcccaggtttaagcaattctctgcctcagcctcccaagcagctgggataacaggcgcatgccaccatgcccagctaatttttgtatttttaatagagacggaggtttcaccatcttggccaggctggtcttgaactcctgactcatgatccacctgccttggcctcccaaagtgctgggataacaggcgtgagccaccacgcctggcctagaaacaaattttcttaatgaagacctttaaggtggtgctttttcagccttattgattgggtaagattatactgggaaacctaggaagcccagtactttcatatattgtatttcatccatttgaaataaatattatatatatttttaaagttatgtcatcttgatggtggttttcttttgtttgctaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagtaagtactatagcttaactaatcgtgctttgacaccagttccttgtttgctctgcatatgaatgggaataatcaaggaagacttagaggtgtgaagttgtaaactcctaacatgatagggtcttgttaaggttcccaggaaatttgaaaggaagtgctaaattttactgtttgtaactttgctaatatatatctattaattaattaattaatttattattattatactttaagttgtagggtacatgtgcacaatgtgcaggttagttacatatgtatacatgtgccatgctggtgtgctgcacccattaactcgtcatttagcattaggtatatctcctaatgctatccctccccctccccccaccccacaacagtccccagagtgtgatgttccccttcctgtgtccatgtgttctcattgttcagttcccatctatgagtgagaatatgcgttgtttggttttttgtccttgcgataatttactgagaatgatgatttccaattt

SEQ ID NO: 16330 - DNA, 1059 bp, Homo sapiens
caagccttccaagtagctggtactgtaggcacacaccactgtgcccagctgatttttaaaacttttttctagaggcagagtcttactgtgttgctcaggctagtctcaaactcctggcgccaagtgattctccctccttggcctcccaaagtgctgggattacaggcatgacacctggcctaaagtcactaaattcttttaaaaattggtagagcaaatgtttacttctgaccttaaagatggccttagacattcatttgaataactgctattttgatttgtgtgaaaaagtattatagtttctagtcttactaagaacctctctgaattacttatttttatagcatttaactcaaaacattttagaactccagtctttaaagtatatatgccttgccctagtttttaccacaatccttttgaaaagatggcttgattttatttaaagttctaatattttattctttaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggtgagtctatagggaggaggaatttatcggtgaatgcttgtgtatgtatagaaagatgctttgagtagtggaataccaacatgagaagttcaattaaaagattatgccttatggaagggaaatttcactttggaacaaagtaacattttaaaaaactttaacagttaaatttataaaaatacatacttagtgaatataattaataagttttatgaaagtataaagtagaaacaaaagtcatttagaatcctgcaacccagagataactacagttaacatttggggtattttaaatctttttttcctctgcataaacatgtactttgcttttacataattgaaagtataggttatagagtatttttttcatttcattgtatgaatattctctaccttatttaattatagctttactgttagaaggtgaccttacat

SEQ ID NO: 16331 - DNA, 2002 bp, Homo sapiens
ggatctcgtagaacacttaatgtcagacaacaggacaaggtgaggttttactgaatatggtgggttgtagtcatgactcatatcatgagttctgaaacaactgttttcctattttgatcctagaaaactttttttttttcctttgagagggagtctcactctgctgcccaggctggagtacagtggcatgatctcagctcactgcaacctccgtcccctgagttcaagcaattctcatgcctcagcctcccgagtagctggaattaatgggtgtgcaccaccacacccagctaatttttgtattttttagtagagacggggtttcaccatgttagccaggctggtcttgaactactgacctcaggtgatccgcccaccttggcctcccgaagtgctgggattacaggcttgagccaccacatcctgtcctagaaagctgattttgataaagaatttaatcaaaagaaaattaccatagcacttctttttattttttatttcaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggaggttggtggatcaccgtcatgtttttctcatttctggagtgctctttcgactggggagtggaatttaaagcacaatagacttttctgaatattcttttcaaggtggtagatatttttcactgtagagttgcttgattttattgtaaagtttcttttatttttttcttttcttttttgagacggagccttgctttgttacccaggccggagtgcagtggcatgatctcggctcactgtaagctctgcctcctgtgttcatgccattctcctgcctcagcttcccgagtagctgggactacaggcgcccgccaccacgcctggctaattttttgtattttagtagagacggggtttcaccatgttagccaggatggtcttgatatcctgaccttgtgatccgcctgcctcagcctcccaaagtgctgggattacagatgtgagccaccgtgcccggccacaagtgttatatcttaacgagtgatctttcttgtgattatgtagtaagtagctcaggcgacatttatgcatttgatgttctttaaaatctttgttaataatgtaggttgttgtgtttttcctcaggcgatgtcattccctagtttttaaatgtatgtgaatttttagagctctttcagcagtctacagttgctctttgtgtgtatgctgcagtgatgtttgtttctgtttatagaggatcttatgtctctccttgatgccgacattcattctgcccacccaagtgtcattattgatgcagatgccatgttttctgaagacattagctattttggttacccttcttttcgtcgttcatcactttccaggctaggctcatctcgaggtaattttgcatttatttatatatttattttggtcacaggctagctgtatggaaagatagtggtagaatctactgactgtatttgaacttctaatattacagttattattagttttttatgaatgcattagcattaaaattaattattttttattttgaagagccacaatagtattttagagttgatcctatttacgttgtggaattgatgtcaaggactatgacttcacctaaatgtatttttaattaggaatatggattctgaactaaaagcagaattctactttacagtgacatgcagcattcagaaaacaagtcttagtttatttggttaaaataagtgatctgtttattttaaatcctggttagataaaataatgaaatgtgaaaaaacttactagaatggatttaggaccaatattaaatgaatagaaatgtttagtttattagaatgccttttttttttggggatgaagtctcactctgttgcccaggctgg

SEQ ID NO: 16332 - DNA, 1266 bp, Homo sapiens
attcagaagggatatggttattctaaggctgagggaatagttatgtaaacaaaaataaaagagtagtttgtgagtatgatttagttagggaattgtgtttggagtacaggctccttctggaagagagagatgcgattagagtgacggtagtgaccagaagaaaaaaaaacgctgaaataaaaactcgtgtataagaaacaaggagttacagtgtgttcacagatttctttttccaagaattcccagacttagctttcattccctggatcctcaagttcctagcagatcttaggaatcaaataaggccctatttagtttgagaaccacttcaagccagagcttggcagagttgaagtagcaatatagtgagctatccaaggatgaaaaatacatttcagtaatattgataaatggctgccatttattgaacacttaagtgcctgctctttccaaggtatattacaaaattatcttgaatccttacagcatcactgctagacaagtggtagttctatctgcatttaatagatgaagaaaccttccatgcctctgggatgttaaaataagctctaccaaagttccagagccagttcacagtagagatggaatcaaacccaggtttctgtgacactacagcgtactcttcacacctcaccaagctgcccctcacaagagagtaggtgtgatgcctggggctgatgaaatggcagcttaggacgtaaagtgaccatttcaaaggcagcaaaactgcgatttcatctttgacgttaataaaacggcaacaagaagccatctcagtaaatctcgtacaaagaaactctccagaatctaatggcatcaagatcctcgatcaggaatataaccccgattgtcttgtttctatagagaaatcagatttcatttcaggtattttatttcagtttacagttctttctcaaggactgaataacttaccaaatagcagtgtttatactatgaagtacatcagctatctcttgagatattttatttgtatgtagagttaaaattggatttgtagtaatttgaatacattatctgcatttgggagatgctttacggaatgaagtcacaggtattcagaatgtggatggtctatggtgaagaaagcctagtatattctcttgaaattttggtcggatgctacacttttttggtcaggagccctgaagaagtctttcggtcttatctgctagcatagtttgattcttgtatgaatgtatatatagtcttactgttaaacaaatg

SEQ ID NO: 16333 - DNA, 1513 bp, Homo sapiens
acccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaa

SEQ ID NO: 16334 - DNA, 1336 bp, Homo sapiens
acttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcatgttttactttggcttctatctgaaatagaggtaaaattttacatatcagctttatgtgtattaacaatcttgctttattagaaagaaaattgattctgctaaaaaatgctggaagttatatatagaacagtgaaattttggtaaagtccagtatatatgtgagcactgtttccaggacagccttttctagacacttcagttcactagcctcctaacaatttaaaacccggactaaatgaatagattgacaaattaagctagatttattccaagtaaatatgggcattaataccattaaatggaaatactgggttagagaagccacacattgcttaattccttttttcttctttttagagtatatattttagtttcctaacctgtcttggccttaagaagtcttctgaactctgctgaaatgaaaagcatcatctctttgttctttgaacactttagttaactgggtgacttaatattttggggagtaactttaaattcaaagatttacttaattattcaggcaatgcactagtatagggtgg

SEQ ID NO: 16335 - DNA, 1190 bp, Homo sapiens
ctcaattctttgttaccctcttcataaacttttgagccatagaagttaggtatcataaatctccttagtgatcatcgagttcatcactgtcactttactgatggatactctgagactcagaaacagaaaactacctgccaaaggtagcacaggtagttaaactaaatagttagaattaaagtattagaattaaataagaattagaacttagttagaaataaaatgctagcattatttccagtgaaggattatagaaaatactctatgtattttgattctcatttttcatttatcttactgttggctcaggctgtttttcacgatagagatgtgaattgccttctcacttgccctcttctttctcatctctgccagtactaatagtaactgctatttccagggatttctgccagggactgaccatttccttaaaggagcctaccttttatttcttgatttttgaaactgtaattaataacgctgttttagttattgaatggtagaatctcagaaccaatattaatagttattagatgagttttttgagaatgaaatttgaaaggaggagtttataagtgagatcatgaaagcactgggttactaagagagttgaagaaggtggtgtcactaaaggtgagtaaaaggaacagactgatgcgaccaggtttgatatttgctcaattcatagatttgcactttaattcatgagtttaattcacaggtttggcacttaacgtgctaaatcctagtttaatgatgtgatgaaattcatagcataaaattaaggacataagaaatatctcaatgagtcatgttagatttggtttctgagaatggtacccaggacattttgaggaagaacataaaacatttcaatcacaatttttacttcaaaagactgtgaaaatatgttcatcccagttatgtttcaactgattggtataatgagttcaatactaggctgactacccattatttaaagtgctgtgatttgttctgaaagtactccatatgatggaatacttgctcttgcttcaggagataacgcatcatctggaatgtgatcaacatagcttgaggttttatagtctttgatatgtatcctgtgaacatttattttttttaactgaagagtttctttcatgtggaagagtcccaatcctcttgatatattttcttcccttcatcct

SEQ ID NO: 16336 - DNA, 1147 bp, Homo sapiens
ccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggtaaaagctatcacttggattatgtctctatttacatttaatgtagaaaatgtttcatggaaatatacttgtcatggatgtaaaagttgatttcaggtgagaaaatacaagagccataggtaaggatttcctatacatcaactgaaactgggatgaatgtttcatgacttccttcctcaagctttagcttcagttgtatagtaaagcacttcctttattctctgaaaaattaaattgagctgcaaaggcagattaatagcaataaagagcagagtcagaagaacagaccttgacattgggagaaaaaca

SEQ ID NO: 16337 - DNA, 1219 bp, Homo sapiens
ctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgttttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaagcctggtaagagttctgacagaagagaactcaatttcagtcattcaacaacaaatagtcactcaactcctgctctttggcaggtacgtcaccaagcactgaggatatagcaataaataagccagacaatattcctgccctcagggaattttca

SEQ ID NO: 16338 - DNA, 1177 bp, Homo sapiens
gaaactcattgaagtggatgataaacgcaaactctgcactttttatgagaagcatatggccacagaagttgctgctgatgctctggttgaagaatggaagggttatgtggtcctaatcagtggtgggaatgacaaacaatggttccccatgaagaggggtgtcttgattcatggccgtgtccgcctgctaatgagtaaggggcattcctgttacagaccaaggagaactggagaaagaaagagaaaatcagttcgtggttgcattgtggatgccaatcggagtgctctaacttggttattgtaaaaaaaggagataaaaatattccaggattgactgatactacgatgcctcatcacctggggcccaaaagagctagcagaatccacaaacttttcaatctctctaaagaagatgatgtccaccagtatgttgtaagaaagcctttaaacaaagaaggtaagaaacctaggaccaaagcacccaaaattcagcgtcttattactccatgtgtcctgcagcacaaatggtgccatattgctctggagaagcagcatactaagaaaaattaggaagaggctgcagaatatgcttaacttttggccaagagaatgaaggaggctaaacagaagcgtcaggaacaaattgctaagaaatgcaggctttcctgtctgcaagcttctacttctaagtctgaatccagtcagaaataagattttttgaataacaaatcgataagatcagactaaaaaaaaaaggataataggaatatagactccatttgtttaaaaattaaccacatgagatagctttttgtggagcttagagaggcagggttagtaagaataaaatgaaatactaaagcactaggtcacataatagaatattaagttttggaatgcatttcatcaggaagttacgtgtgttaaaaataaattcaataaatttatgagtaattaattcatcatagacaaggtaaagcctatctgtaatctttgttttttgtttgtttgtttgtttttgttttgagacagaagtctctttttgctcagactggagtgcagtgccatgatctcagctcactgcaacctccgcctcccgagttcaagcgattctcctgcctcagcctcccaagtagatgggattacaggcacccaccaccatgcctggctaattttt

SEQ ID NO: 16339 - DNA, 1132 bp, Homo sapiens
gtaaaatagagaagaatgtttttgtaagcttctcccttatgtcgtatggctacctttaggtgctgcaggacagcatagtgtcttaaatgaacccactgatttttcatgaatttttttcctgtgatcatgcaaatttgcaccttgtctttgacagcagaaataaaatcataaatctgattttgcatatttgctctaaggttggcccagagtaacaaagcacaatcaagaccatggtatttgaaattttttaactcctaaaaatatattccatagatgatataatttaattatactccaaatgttttatctaaaatgcattttctgtcttttcctttttactcttgtcctcacttttaatgatccatcggctgacagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagtgcttctcagctcagccaaacgggtaggaatttcaatgttacttttaacttgatatttgagttgtcattacaagatatatttcttttctcttactcattttattgcagtaatgtgtggatgatgacatgttccagagggaaagggcattttaaactagttaacctttctgaaatcaacaatgatgttttttccagtgatcaatgagcctgcttccaagtgaaccttggccagtgttcttaaaatgtagataatgtctttcctcctcagggaggagttacgctgtgacacccaattgccagctgctgatcctttgtaaagataatctgaaatgggggatatttgcttttctttaggttcctcaagttggaaccagctaaattaatttccattcccagcaagatgctgtgaagatgacttctcatattttgtgtgaataatacagttcttgttttgctgacaacccaacttccttttcagtttgtaagcaacatttaccagtagttatcaattttctcactgcaatttttatttccctgt

SEQ ID NO: 16340 - DNA, 1111 bp, Homo sapiens
aaatatcacttgctgttttatgtcttttaaagattataatttttctccttctctttccatctatttctactcacatcttcacagggaaatctgaggaaccaaattgtgcttgtgatcagtttcgttgtggtaatggaaagtgtataccagaagcctggaaatgtaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggag

SEQ ID NO: 16341 - DNA, 1166 bp, Homo sapiens
gttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaa

SEQ ID NO: 16342 - DNA, 1449 bp, Homo sapiens
tcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagt

SEQ ID NO: 16343 - DNA, 1203 bp, Homo sapiens
tggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccaca

SEQ ID NO: 16344 - DNA, 1180 bp, Homo sapiens
aaccaatgtcttgtaatattgtaatattccttccccgttgcttccagtctttcatcccctgaattatttaatttaagtggctgattttctcattagtatgagtgctttgcacataggttttcacacatttttttctaatgggtgaatgaaagtcatcgcttagtagccttttggaacagactgacagcatgtcaatgaaccttgcaaaatcctgttactcaaaaataataataggataattagcctcttgattgagtcttccatctcaccccatattaaagaaatagtggctagcattctcctcatttggattcctgaaactggattctgtttttaaatttccttggaggagattttcttataatactcattcttaagtgtttgcagtcttaggctagtgaaatagtacaatctaatgacctgctcgagagttttctttatctcaccctgggtaagttattaaataacttttatattttttcttagatatcttaatgcaattcagacaatgtgtccacacattcttcgctatttgactacagcagtcataacaaacaaggatgttcgaaaacgtcggcaggttctaaaagatctagttaaagttattcaacaggtaaaactaaaatatatattgatttttttttttaaatacctaagctttaggtctaacctctttttctaaggtaagacttagttcttaaggtacaaacgtttttaaaaataggtggaaggaatacttgaagtttagaaaagagaagaccctcaaatgggcttttgttttccttaagtccaagatacacaagttggatgtggtaggaatgattattactgtctgctagatgaacacttaatatatacattatgtgtatgtgtttctcttattgcaaagagtgaagaaaatctggaacctggaggtgggggtcattacctgtgtaattctacatgggtgaactttatatacaataccgtttcaatagaccccaagttgggcaaaaggtttcaggcagccatgctgattgatatttagtgagcttgtcagcaaaacccgtagattagaaatataacttaaatatttatttaagagtgtattaaatacaaagaagttattgtcattcagtagggaatgaatacccttatgattggggaagtttattactgtttattgaccaagggagacttt

SEQ ID NO: 16345 - DNA, 1134 bp, Homo sapiens
agtatagctttatgtaacttttagccagttgctctgccacagacatagacaaagagagataagatttcacattatccatcactgcataacaaaccacaccaaaactcagtggtttaaaacaaggacttttattatttttcacgattcagtgagttggctgtctctgctgtacagggcctctcagcctccagtagactagacgaatcttctttccatagtagagaaaacatcttaagagagcaagctccaatatgcaagagcttatcgatcctgtacatctatcatatttactaatgttccattggacaaagcaaatcacatggccaagtctagagtcagaatgaggggactacacaagctgacagcggatggtatgactcattgggggccattgatggaacaatcttaccacacaaggacaaattataatttatccttgtggctctctttatttttctaacaacttcaacaaaataatcctgtttatatgttatagtttcttgccacaaattttgttttttcaaacttacctttccaggtttgttttagtatgtatgtacctggaaatttttattactttttataccatttcaagatatgtatcttatataaacctcaagttggattttatattttaataaggaagttaagaccttcatttaagaggcagaagattaagataagaaatataagatagaaaagctttgttcctaacatatcttttgcctgtctgggcaagtatttgactcaactaaattttaatgaacgaatgaatgacagagaggaggaaaaaagatgaggattgcatacatgttctaaaccctttgtcagattgcagtttcctagagagtattgaggtgctaggtagaaagttaggaaaggtcctgaggactggtattgacaattggagtcctaatagtactctattcgtattaggaaagagagactagataccaaacatcacgagatcatagagatggaaaactgtatagtaaccaaaaaccaaaacagtgatatttccagaactttttagtattgttgtaaaacttcatgaaacaaaagaccatttaaatagtgaattattaaaaatctttatgatgggaaagtagatctaaattttctctaaaattttcc

SEQ ID NO: 16346 - DNA, 1325 bp, Homo sapiens
attagtgagaaaattttaagactttcaacattttatttggtgataataaaaaggcactgctatttctttctagaatttatttgccattttacctgtttggtattttctaaaagtaaaagtatgtttcttttcagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataataatcttttatttatgatgttgattggctccaaaatagtcttaaggaaataaatactgggtctgtaggggaaaagtagacttcatagtttaaaatc

SEQ ID NO: 16347 - DNA, 1189 bp, Homo sapiens
agttacttcacttctctgtgtcccagtttcctaattggttaaataaagatgatactcatagcacctgcttcatgggttgcttgtaaagaatgaatgtcatcctcatcaacagtctttgttcctcatcaatattgttttcgatcagctgccaggttagtggagtgttatcccaggactgaacagacaggatgaatttgatgacctttaagataatgctctgatgccaaacgcttggtgactaagcatcctgctgcagaaggcacttttccaactctcaagaacctatgcccagtggcctccagaagttctggcagttttttgttttcatagcactgctgaactcttttgagagatattccttttatttataacgttaggataataagcgttctgtgcatgtatgctaacgccagggaattagaaaaggaaggaaaaatgaaaacaaaaagaatacgtgcccaaactgataactaactagacttatttttaaagcactgcctgtaatctggtctcttaggacattattaattttgcctgttttcaagatatggagcagtcctcatacatcagaacatcacagtatagaacaatcctgagatctactaagcagtattaagccattctaaaacactgatttaagtaaccccaagccctctcttatcttttatcactgcaaagctatcaaattaattcaggttggaccacctcaaatagaggcagtaaattaaaaaaaaaaacccacctagttcccacccttctctcccatcctccttctccacccatccccccaaaatacacatatttttaaatgtacaggtctccagggaggagagaggaaccattttcactgaagctaagcacagctattaaggagcagcaggagcaacggacacacgcaattatagaagacactattaaaagaagctgctctaaagtacattcagtagaatggactcttaactgctaaggcttggggggcccagccaaggtatccaagaaacgcttcacagcctaaaaagggtttttgttttagtttttgcaaattactttcctgaaccccgtataggtatttatctcagaaagggaatatttggttaaatgagccatacattgataagatacatatacaggtgtttttttttttgcattttgagaataaaagtattcttgaaaaattgtaaatgtaatt

SEQ ID NO: 16348 - DNA, 1139 bp, Homo sapiens
tcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatataaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacacataacggcgttggtatggtttatatggattcactttcatccttctagcaataggaaatacagatcattgtaatatatatatatatatatatatatatatatatatatatatatatatatatatatacaggctctgctgaattgaaatggtgaaatcaaatcaccattctaaaaaattattacttatattgataaagcctggactctctcaacttgttgtgctttgattt

SEQ ID NO: 16349 - DNA, 1187 bp, Homo sapiens
aagataccagatgtgacaaacaaaaatgattttctattttggctctggctgacagtatgaaaagctgtactatttacaaagatagagaaataagaagtaactgggttttttgtttggttttggttagaggactctgtatagtgataatgattttatttttcgtgagcactttgaacttcacatatttgggatccaggctttaatactgtcagctggtgaaaatatgggtgtagaagatatttttgtatgaacataaaaatttggaaattgagagtttttaaatattagttgaaaagtggacatacttgaaattccttaggttttaaagttaacactcgtttgtagataactagattgttgccattatactataccatcatttttacttgcatgcttatctccctactagcaggtatacaccttgaggacagaattgtctacctttttttcaggttctctaccacctaacatagtagctggaacatgttcactgggcctgctcagctaggtgtttagtgaatgaataaataagtgaatacgtagtaaaccaaacaagaatgtagaatgagaaggaagaaatcctggggaaaatatgatttgagattctagtattatttctgaagagtggtcagacaactttgatgagaaccagaaaagagtagtggggaccactgaaaacaagggaggatagagtcgcacaatcaggagttactgctcagttcatttagctccctcccccgaaaccaagatgaataaattacctatagaaagatctacatacacatgggaagaatgtctggttcatttaggatgaaatttgagattccttatcattgtcaagaatagatgccatcgctggactatattgtcattaaaaccaagttcaggtcgggcgcggtggctcctgcctataatcctagcactttgggaggccgaggcgggcagattacaaggtcaggagatcgagaccatctggctaacacggtgaaaccctgtctctactaaaaacacacacaaaaaaattagccaggcatggtggcaggcgcctgtagtcccagctactcgggaggctgaggcaagagaatggcgtgaacccgggaggcggagcttgcagtgagctgagatcacagcacagtactccagcctgggtgactgaaaacctattccatgttcttcacacatcaagt

SEQ ID NO: 16350 - DNA, 1189 bp, Homo sapiens
tactaactgacaaggaccatttaataatctacccagctaaggttagcagtcaatattttacatgatatttcactgataacttatttatcatattttacatgataacttaagattctgtgggtcttaagttatgcatattctcttttattactttaataaatattaaaccacaacatgatgtaattttagcttattactaagtattataagagcacttagaatataactttttacaattaccaaaaattttttaatgtcttatcaacatgaaatacttagtcatttatttagaaagtataagtttattagtggatttactgtgtcctgatttaggtcagttaccttaaaaatacgttcatttgtctgtttttattaatgctacatgccaaactaatgacatttaaaatcataggaaaaagagatttggcatttgatttatatttcatggcaaaatgcacaggtttgggtaatctcaggttcttaaattctttccacattaaatagtgagctaattctaacttttttactgtacttcttcgtgttactgcattaggtttttgaatctgcttggatgactcccgaagagcagtttagtctttgagaaaaccagatctccattgcttccatgaagatcttattaatatttagataatggagagtaacgaaaagaatttggacattgaatatgtctttgtcttctagctatcattctccccaacttaatctgtgaccctgagaaagttacttcatttctcttgagtcctcaacaaatttttcttacacagtatatgccatcttaattatcttaagtatgtacttgatcatctctagaggttcctttctagtcttaggttgtaatagtctttgtcatactggaaaaacatttttaaaaaccatcaaaatgtattctttttttctacactggaattgacatatggcactataaagatcttgtgatggtagaagtcatacatttgaacatgagaatattaatgacagcttgtaaccacagtatttcttatcctattctaagaaataattttagttattaagctggttttttttggtatgtcttgagtttatttgaacgattgaagtatttggaattgcgtcatgtaatagttcactgcaaaattaaagtaatttgtatgaatgagaaatggaatcagtatggtaaactcatttcatt

SEQ ID NO: 16351 - DNA, 1107 bp, Homo sapiens
accaaaatttcacacatttcattatttcctttcaggctcattattttctggtgttatcaaactgagtcagctctcacctcttacacaacttgtactcacttaagttttgtctttcaccataccttttcatattataaagcgaccagacactttactttgaaaacttcttttttaaaaaatttccacttgacaaatgaagaacataatccataacttagttacacagttgaacttttctcccccattgcttgtataaagtgtggagcacccatatgaattataacacagagagctaagaggtagatatttgagatatatctatcatttatagtcattttcacagatatgcaaagctcataaatgccatcacacaatctcctactgtcatactcattgatattacactttattattgtgggaaaaagtacttacattataattactcaaagatatagccatgctataattctaacaggttggtgattagtttgtcaataccctatcttacgtagaaattcaccagttatctaaaaacgatccattaaatcgacttaattatgtttaacctgacaaactacagcacatacttattgttgacataaaaagattttggttgaattcatagttttatgtctttctcagtgctcgacattgttgttagcagtaaacgtttataatacgtttaagtttagattaattcgtctcttcatgaggacattaaaccaaattttatttaaaaaataattgtaatcttggaatatacttaatattggtaaaatcagggaaagatatatagtgttttcaaaccaaaattataaaaaatgtcatagtagtttgaatatttaccttaattgcataaacttggtttatatccttattcaagaatgctctgaggttgtatcttctacaaatattgctattttttaaataaagtattagcacatttaaattttttaaatacaggtgttttttatttttttggaattctgggaacgttagatgaatgtgattattaacttctcaaagcaatcataacagaactcattattagagatattattgtataatttattaacacatcgtggatataggaaaacatctgaaagt

SEQ ID NO: 16352 - DNA, 1303 bp, Homo sapiens
agagggggttcaatttagggaactcccctccagtgaatatacatggagctgcatttttatcattgtcaatatttgttgttttctcagcatgtcattactcttctggcctcaagtgactcatggcttctggttataaggcgggaatgaaatgtcctatgttttattaaattcatactgcattttgagagtatggtatatttgggggccttatatctatatcaccggaacccctttccttcctttttctacttaaaattggtttcatccatgacatcttcatttgacaccatattgtttgactgtttctggaatattaccttttctgccattgtttatatactctaagactttgaaatgacaatttattaagcaatggtataaaaaacctgagcgtagtggttgcattttttgagcaagatggagatgttaatacttttctaaaaagttgtttttctcaattcctccacttccttaaatccctgatttcaagtttctattgcatcattttaacagccttttcagttcctccacattagctgctgaagtaggaaaccttaaacaagagattccttagctgtgttctacaataatagccaaattccaaccctatgatttattatcttcaaaggctgtaatctactaaatttcagagatctgataaaattacattaatatatacaaatacatgcatatgcatatataaaaggaagaatattgaatcattctgtggttgcaataaaatttaaatcttttaagattcacattttatatttgaatagtgcttttggaaatcaccaattttactggatatttggaataggaagggtagccaatttaatttattgggcaacatttaggttattagctgtatatgaaattttcaatgtgtacatatcttagatgatgagctttttaagacacctaacagaattaagaaacagcccattctcattgtgaatttgacaccaattctactttggtggtattagttggtattctgaaattatcataccgaattacctacctctaattcattaccctaccagtggtagaaaaaaaaaaaaaagcagaattttgaggtcatgtttactaaaggccaaaaaaaaagtactataagtttatagtttcagaggcatagttattagtgaagatgtcctgtaataatttaaaatacaccatagaaatatacagatataatttacatgttttgaacccaaattacagtagtgtataaatatatgcctacagaatgcatgtttatatttgaaacaataaaatagaacttgaaagtaactacaattat

SEQ ID NO: 16353 - DNA, 1172 bp, Homo sapiens
tgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtttgtactttgtattgtctctttgtacagaaaaagttattagaaatgaaatgtgaattcttatattcatgttaaaaccaaggtcccagtaccagacaggtagcctgctagatctagcagaagagatggacacactccatagctacttcatacaagtatattcagagttgtctaaagacaacttttagcctcttattgtggaaaacaatcctagcatttttttaaatttgggaaagtcttttcatggaattagctaagcttcacaattctgggcatatgtcatggtaatttgatgttttcacagtcttccaaaaatgttactaatctttatggttgcacatgataataattcatgccttgttccagttttagattataaggcttttgctataatctttctttcagtgaggatatttcctgtatcttggattag

SEQ ID NO: 16354 - DNA, 1157 bp, Homo sapiens
aaaagaagtttcaggccggtgccccctccccctcgcagccccactccccctcgctgtctctttctggctgattttaattctctcctaccgggcgcagcggaggagctggaggtggttggacccgaggggccgccgccgccgccgccactgcaagttttctgggggctcgtgacaagcggggcgcagactaggcaccagcatgcagagtagtaagttgggcgaactcgggagggtcgggagggtctcagagacgggcctccgtatggtctccaaagtgggaaaacagcacaggactgcctttggctttgaagagtttgcaaatgcaggcttcaaacttttttcccttaaaggcccagctgggctctggagaaggcgggtgtcgcatcccttggtgcacccgcctcagagcggctcaggacagcttggccgagcggtctgtgccctgtccgtaccatgtggcagggccttgcagcccgggcgcttccgtaggggctgaggaaggggcagacttcctctgcgatgcggttgatgcgccatgtgtcgcgcgggtcaggggacactggccggtgattaaatgcctgacagcggtgggacatccaagcggacagacgctttgccttctgtctggttcctgtttgggatctagagaaacgcatctttgaaaggccaaggcaaacatcgctgtccctccaaataactccaggattataggaccccaggaataatttgagggtgaggcggcggtgggagctgtttgaagtgtaaagctgtttttgtggctgggaaagctttttcgttagtacctgtctgagatggtggtgtttccccctttccccagggaagtcagcaactgttttatggccccaggactctaaagcaatttaagttagagggtgagaaggactggtgggtttcagagggaatcttggacttattaaattttaggaccggctttacttccctctatctttttaggcctcatatttgatgctttgaaagttttttgagtaagccattgatcttaatgatgaatctaaattatgatagaatattcattcttatgccattttggaaaatcacggctagagtttaagcgaggtaagtgaagtgagaagctcagcggaggagttaaatctgagacaagttaggcctattca

SEQ ID NO: 16355 - DNA, 1191 bp, Homo sapiens
ggagaagaaagggttgacaaaagaagtaaaaagaagtggctggagaagtatagggaggacatcagaagtgaatcatatcatatatgcaaaaataacagaatgttttacagaggaatttatcaacagaagaaggagcgagagagagagagagagagaaagagagagagagagaaatggggagagggaggaagaaagtaaaaaaggaagggagaaaaaagaaagtaggaagaaaggaagaaatggaagagaaagaaagaatgaaagaaagaaagggaaagaaagagaaggaaggaaggagggaagagaaagaaaattgactcctacttaaaataaaaatataatccattgataccatttgaagtgagaaaagactcactgcaggggaatgttcaaaggtaaaaggacaaagatgtctactgcaatgtcttggaactgtcttactttctgcccaacttggcactaccataaaatattggaagccataaaatatttagaaactgattattaaacaggccttgaaatcacttttgtgccagtctgtctcctttcattttatctgatctctgcattcagttctgcgttagaacatgcactagttaaaatgtccattattatcacgaataatgaattagatgactcatgaagccagtgtcttttaaagtcagacttccagaggaaaataaaaattttcactgcctgaatgtctgatcttatgtggatgataccgttaggctgtgtccccacccaaatctcatcttgaattgtattaaaagctcccataatccccacatgttgtgggagggaactggtgggagataattgaattatggggacaggttttcccatgctgctgtcatgatagtgaataagtctcacaaaatctggtggttttataaagggcagttcccctgcccacactctattgtctgccaccatgtaagaaatgccttggctcctcctttgccttctgccatgatgatgaggcctccccagcaacgtggaactgtgagtccattaaacttctttttctttatatattacccagtctcatgatatttctttatagcagtatgaaaatgggctaatacagtaaactggtaccagtagagtagggtactgctattaagatacccaaaaatgtggaagtaactttggaactgggtgacaggtagtggttggaacagtttggag

SEQ ID NO: 16356 - DNA, 12042 bp, Homo sapiens
atttctagctattttaaattaagttgtaggtgtaggttgtgtagcataacttactgtgacatttacattttagtatcagtgaaattttaaagatacctgataacaaagaatgagtagtttcttctgccaagaatctcattttctgggctttagctcaaattcgcatcattttcaaagttactcaaatcactcaacttatgcttgactctgtaaaactccagtttctctactttttttttttttaagagtgctaatgaaacaaagatcttggatagggcctgtaattaggtaaattttatgaagtagtcagtttagcacttacttttgaccatcagactaaagtatttttaacatgcttcacagattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcaggtaagtggccctgcctaatgaaaagcccatgttttagaactttttgcaaaagattctttcacataaactttacctgtgaaacaagaaaacagttacttaagaacgtttataggttcttaaaacatgtataacatggagtaatagtctggccctgttaggatgtcagggaaaaacgccaaactgataacatgaaacaacacattatttgaatactaattgctcatattagaagaaccctctgctgccttctttgctgtatcatttgtgctttgataaggtcagtgcccaagagggagggcttttttatatggctcagctttatttcttgtacacgatcctaagaggcttagggtattaggtctggatatttaataatgctcaggaaaagaacagaaatgcttttttcttttactggttgtacttacccttgttcagatgcagactcttgcagttgtaaaattacagttgtttgagttttcaactaaaatttgaattttctgaacctgacattggcttcacctattttagttggtgataacgatttcctccaccgtgactgccttagctatctagttgctgagataatgtttattatatttgtaaaatgcagattgaggtttccaaaaggaagtattgttccctttgttaaattaatgtttatttccccctcatctattactcttaacagaaatgtgaatagagccacatgtatagctcctcttaaatgccctttgagcgttatgttagtgattattttgtctgtggtggaaggaggctagcagcagacttgtggaatgaaattaaatggtcagagtaggtaaagaatcaatatatgcttgttggctgaaagaaacaaggtgtgttttcttaagcaaccagtttggagcagactaaattatttatcagatttctagttatcttagatagagacttgttaaaaaaaaaaaagtgtacagactttgtacttcctcgatataaggcaagtgggatgaacccagaagggccagagacatcaatgttcttctctatgctctggcacgggtaggactgtggttgaagcgccgccttccattgcgttaattgatcacaaaggccactagaaagtcttaacggggcagggagatggacgatgaatgtaaatggagtgctcagtaacacagccaggttgcaaggctaatttggcaccaaaaagcatactgtttgactgcaaacatatattcataatagtcctttaatttgtctgttttagaaggtcatatttttctttattgcttttacaaacacattgggcacacctgtatttaaagcatttagctaagaacctttttcagcatacaaggttacaatttgatgtattaagtatatagttatataatacttttaaatttactgcatgaaagcttttgcttacataattcatgtcttcaccttttcccaggctgcctttattgagcatacaaaagaaatacatccctgatggtgctttaacattaccaatgagctggtctataatgtccatttgtccaaagcagcatttataatagccaagaaaatgttctcagtttgccctagcaactgagacctagacaaatattttattatagtttttgtcttctgtatttttacgtaaatgaggaaaaagaggtcccatttctttgctttccatatgaagttatttaaagtgtaaattggtgttcctgttaggaggaaaaaaaatgaagcaactttgaagcagtgcttttttgctagtagacacttacattgaaccaaatcgaccatactattttaaaagacagaaagataagttttgtacatctcaatttttaatttctgacagtaattgtgtgatgatggctcaggccagttgccataaaagtttgtataagaaaccccatcagaaataattcttatgcaggtgcttaaacttggtctttcctttcacagcctatagacatgggcaccagtttctttgatgtgcctgataagtttgttctctgcgacgactaaaacatactgtatttgcttttgttgaaaaattcaaatttttttattttaattttattagatggaagttctagtaatagttattccataacagcctttattagtttttaaaaatgtgtatcacaggcgttcagcttttcacacatgtaaaacaattctgtttttatttcctcttttaaaaaaagtaaactaagggtgggcatcatacattaaggattataagcataaattgatactgtagccagagcagacttaacacttcatgtcctggttcacatctgtttatctgttttcagttctttatttgcttggcaataaaagaaaaggcaatgttactgaaactcctaacaataagtccctgtttcagcatcctagttaaactggtactgaaaagattcccacaaaattggtcttggtagtggtctgattttctgtcattgttaatttctgatgcccttttaaggcctgtagtacacagattgtgtgtgtgtgtgtgtgtgtgtttctgattgttttttttctgaagagcattatcataatataaaagttatgaaatgcttaaagtccacatatttgtgcttgtagcagtgttctttcacaataacttcatatacttgcagcagataatattagtactttatattaaagacttttctggtagaaacagtgggtctgttttagtagtgcctttctcattactgtaaacaacctccaagatttaaggtctaggtgtattttctctgcatatggcagtacctctcctgtgctgttattttttccctactgtcactgctttccccttaacctcccagccacagcattggtgatgatcttttctttctctgatttccttttgcaattaatgacataaatgacttaacaactaatcatgtagctaacgacatttcctatacttagtatagccctttgggcttcaggttgctcactggtaaaaatgaaaggatcagaaacctgaagctagtgcctcctgtcttcttgccttctcaggacctcattaggttgatctactccttccttcttcatagattttcagtttctttctatactagtttttttttttcaatctttataggctcatttttccaattaaaaatttatgtttaaattttcaactctttagacaatttgaaagaaaaatacagtgaacatccatccataaacctttcatttagattcaccaattgtatatcatgccacatttgcactctatctacgtacgtaaacactttttctttctgaaccatctgaaagtaaattgtagacatgacttttaacccctaaatacttctaaaatgcgtgcatctcctaaaaacaaagacatttaaacttgtttacatccccccatctcaaaagaaaaacttatgaaaagaataccttttaatctcatgcctttagtatccatctccttttgtcttctgctaaatttttctatttgtttcataatcaaacttctcgatagaattttgatgtcactgtttcctcatttcccactgatttcccagtgattgtcaacagtttgtggtgttccacccattatatgtagtaagacctccctccaaagtcacagaagactttgatgtcactatgtcactgagtattttagactcttcagcatgtaatatgttgataaggccttcttcctgagatcctttcctaggagcctgtgaaactatagctcttctgggtttcctctcattctccacagtgaaccccctcttgtgctcatctctgtccgtgttcctcagggtctgtcttctcacacatgtactcgtggggcgattttgtcttactcctgtgacttactgccttagtctaggaccttatttctcttcctcattactttcacagcttcctcacttcctgttttttgaccttttcctctttcaaaattgtaatgatcttgctaaatgcaaattagatgctcatattactcctttgcttaaaatctttagctggtttcccactgtccttaggacagattccagacttgtagtatgtttttaagtcattgcactttgaccgttgtctgcctctcttttcctcagtcttgcccaattctaatacttaagtcggagtgaatttaaatcaactatttagaaattagggtaaaacagaagcaaatacattgtatccagagaagaagaaatgttttgaagttaaaagtgatttaaaaaattacaacacaacaaaataaatatgaaagaagcacttgattcctcagcaggtgaagtcatcagaccatgttactggaccaaggttatctaggtagtgccaggctgggattaaaagataaatttactcacatacaccttagttctatgctccttccattatttgagaaagagccaaaacttcctgattttcttgaggttactgatagaatccatattttagttggatttatttttattcattctcaatattcccaacctgtttccttctcagtctttcccttctctgtaaatgtagtaaccagctgccagaagactgggagtcaccctccattcctctctgatgcctcctatcaaataaagattgcctgctctgcctccagaatctctctcatttctgctcacttttctctatgctctgccaccatcctagttcaagtcaccacaatttctctctgtaatatcacgatagattatttgctggaggtgcagtttttaatatagagaaaaaattgaccatttaaacccttttcagatgtacactttagtcatttttagtatattcacaatgttttacaaccattactagctctagaacattctcatcaccctgaacgggaacccaaacccattaagctgtcattcctattcccctaacccctggcagcctctagtcactttctatctctacagatttgcctattctggatattttataaaatggagtcctggccaggaacagtggctcatggctgtaatcccaacactttgggaagccgaggtgggaggatctcttgaggtcaggagttctggcaaaaccctgtctctattgaaaatacaaaaaatccagccaggtgtggtggcgcatgcctgtagtcccagctactcgagaggctgaggcacaagaattgcttgaacccgggaggtggaggtcgccccactgcaccagcctggatgatgagtgaaactctgtctcaaaaaaaagaaaagagtcctacaataagcagccttttgtgtctaccttctttcccttagcaaatgttttcaaggttcatccatgttgtggggtatatcagaactttattcatgtttaaggccaaataacattctactgtatggatatataatattttatttatctattcatcatttgatggaattttagattgtttttagtttttggctattaagaataatgtagctattaacatacatgtatgagtttttgtgtgagtatatatttttaattccctagggtataaacatattcatagggtatattcataagagtggaattgctgggttatatggtaatttggtttagctttttgaggaaccaccaaactgttttccacagcagctgtatcactttaccttccctcccagtgtatgagtgttttcatttttccacatcctcgccaacaccccacagtagacttttaactaacctcctggtttctcctctccagtctatttgcatagcagcagaatgatcattttaaaatttaagcaaaatgtgtcataaacatgcacaactccaggatatcattcacattgcagttgtgaggtctcattcacaacaaactacattgctggggagttgtatggtgctagtgagcttcctacatgtgcttgtctggtctgcctgacctaatccctgtgctctagccatgccaggcctcttgtgtcatcaaatctgcctaattcttgcccatctcaggcattcagtacttgtattttcttttgcctacaatatttttggcatagctgactcatctttcactttcagtctgtcatctcctcaaagagatactctgatcatgctatctaaagtaagtgtctcttcacctcccccttctctttctcctccatccctaatcagttataagatcaatgaagatatagaacatgtatgtcttattcactgttgtctccctgttttctagtactaaggctggcacataataggagtttagtaaatacctgtttgcagttaatgaatgggtactactctttagaagcttgctattttaaaaatatatatatgtatagtagctgtccaggcgttaccatggtaggagataagttgcaggcagaaatcagtgaatatggtggtcattgtgccagtcattacatcactttataaagcgatgttggtaactgagctgcaatagaaatttcgggagagaataagaaatatgaaagactgtactacagattctaggaaaggtaagaggaaaggagcctcttcatcatgttttgtagaataaatgttaccattgttcatttaaaacctagatagagaaatcatgtgccagatgtcataatctgtgtggttctttcctgtgattactgataaaaatgttatggaatgcatttgggcaggagtaagttaatgaaaagaatttgggaatactgaacttggtataaaaaatatgtattatagatgtctcactaggtatgtttaacagttcctaccctaacatacctgtgctctcacaataagaaactcagctatttcaggtatccctgagattatagttggaagttcggtatggaaagtttagtaacaagttgactcagattttttcctctgctcttgcttttatgcatatgtgtgctctcattcttttagcaaaagccagttcaagttcatatcttaaaactgtttagagcagtagcaaagctataatttaaagtaagacttgtcagtatatttactttacatttcagcaatcatttggggaagaatctacagttgctgatggacagagtggatgaaatgagccaagatatagttaaatacaacacatacatgaggaatactagtaaacaacagcagcagaaacatcaggttggtattgtggaaaaattcaacaaacagctatttctaagtttcatgtatttcaagagtcatgttcaaaatgacctaaattatctttggtaaattattgaccgttagctactctatattatatttttaaaagattattatttttatggcatgtttgtaacatattatttacaggttatacttaaaaatacctgtgttaaagagagctgttaagctcagattgtaatgccaaggttatgcaaataagagatacatttattgagaaaatcagaagcaaagagattccagaatgtcacagctcatttctttactaactataattggtttggcagtggctcattgtggcatagttagcaatcttcagttcatttaaaaaacggagcaattgtgattaagagcaagcaatgttgataggaaataatagaccaactgctgtgaagtagatagtataatacagacaaaaaccctagaattatccgaatattctcatatgcacacatctacggctgtgaccatataaccttttctttattcatgttgcctgcaggccacatggttttcacagttcctggaatattgtatttggactatactgctctaaagtgttcttagcatttgattcatagattagttgattccagaatgtttatctgtgaaagtagtatttatatatgactactctgttcattaaaatgtactttaaacagagctttgttaaatatagaattctaagcacaactgagtggtttctaagaatgttgtatttaaattttctcttaatatcagagttcattttcagtatatagtgaaatttaaagtactttgtttctaccagcttagaattgagaaaacatatgtaaatcagtattttttttttttaactaaaaagatgggagtggttacaaatgtctgataaactgagggggaaaaaagtcatctcagctggatttcattttcatgctggtttttcctgtaggtgaaggactcatccagggtatcaaattgaatatttgtttcctatgagtaccccataatgaatacaggaatctttacaaagcaagttacgttccttcactagaaagaattgttgtttcccttgattttcttaggaatccaaagactaaatttttactagcccagcttggtttctcattacctgacattttaaggttgtgtatgggatattacgtgcttcactgttgggagcagtcatagctgttagctcttattgtagttgatctataagtttatagttaaagtttatatatatccctgctttctcttcagcgaatcataggaatccagagtttgaaagtatttgaagcattatctgagctattaatattatccatctttagttatagagctaaggtacagacaattatctgttaagaatagtaacaataggccaggagtggtggctctcgcctgtaatcccagcacttggggaggccgaggcgggtggatcacgaggtcaggggtttgagaccagcctggccaacgtggtaaaatcctgtctgtactaaaaatacaaaaattagccgggtgtggtggtgggcgcctgtaaccccaactactcgggaggctgaggcaggagaattgcttgaactggggaggcggggaggcggagaggcggaggctgcagtgagccaagattgtgccactgcactccagcctgggtgacagaatgagactctgtgtcaaaaaaaagaaaagaaaagaaaaaaagccgtaacagtagtgaacatagcagtaataacatcatctgtattgttattttaggtcaataggagtaaaggtgaaagaatttccagtgtggtagttcattacttagtcattaaaattaggatgaatcatttattacctcattgtcatgaatggtaaaggaactccctttaccttactagtcatgagcttctttccctttaagccccctgttacttacataactagttttgttttctgaatcattagttatagactcttagagctagagtgacactagagttttcaacaaaggaattttcttctgctattggcgtatttagcttcttagacgcaagttaccaaatgttgccaatgataaaaactgaggttggaattcagagcagtggggttctgctggttgtgtaggggaaggacatctttttttcctcctcagatggagaaaaataaccaaaccattttccctttgaattttagtatcagcagcgtcgccagcaggagaatatgcagcgccagagccgaggagaacccccgctccctgaggaggacctgtccaaactcttcaaaccaccacagccgcctgccaggatggactcgctgctcattgcaggtattgttgcccagtgcaaaacctggctggttttgttcgtttcttaggaagcagaagacagtgagaaatttacaaacagaaaagcatgccgtaaaagctagtatgtttgaaatagttgcaggatgaatttgaatctagcacctgtaatatctgaaatctaagaacttgtaagagtttgttcttttgtccaggtcctttcagtgcttcactctgtgtttctaaacatttttgagatggcataaactttctaaaatgagtcctttttcatggaaacccagaaaaattgtttacagtcttaatgcagaagaccacttagctcaggcctcttactcttccttttccagcacagcactgtacagtgggtacttgacttgaatttaggaaattatttcccttacttggacttaaattgtggcagcacaaatgtatttccggataaactttttctggttatacttaatgtttaataccacctttaagcaggagaggtcctgtgtcctgtactaggacttgattttgaatatatgacattcatgcccttatttggctataatcttatagaaatgttaaatgccatctgattcagtcagatccttacctgtgagaagattttatcaaagtgaaaatcctactcaaaagctgattggcaatttctcaaattatattgatacatttgtaatgtgggaggaaattccaaattccttaacattttctagtgtacatacaaattaaatttggaaatgagacacaattccttcccaaaggtccaattcaaacagaattgagatccttatattttgaagaagtatgtaactgatgtaactgttgcatgggattagatcattaaagacataaaaagcaatgatggagccctttcttcaagtgaactctttactcttactctgtctggctcgtaggagaaaactccttaacgttcccaaagcacaaactgaaaacctaccgtacttgttcacatctgggtccagtgggtctggctggtttgcagctctgtgatttattgttagtatctcctttctacctgtgaaggctagtcagcgctgttttctcagttgtacagcattggtttgatctatttagtcagtccttttgactgacagctattatgtccttagggctgataagcttttgaggagtagtttttctttattctccatgtaattgagagtggacagtagcttattttcaaaagaacttgtatttcttatcccttatggaaaaataaactctggattcaaaacaataaacaggtgattctgttttatgctgatttttctgtttgactagctttctggatcattttacaatttgtggaacattatggctctatctctttctcaaatgcacaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgactgcttgctcatttgattttagatgtattttctctggcttacttttgtttgcttatacttgtttatttctaaaagctaaaacaagccctgaccggaagtttcaccaggcagaaacctataggctccaccacttttgctgcctctcaggtgccacctttcaacccacttctcccaactacttatcccagctcctgaccccgaggccctggcatctactgtgaatattttttttttgaatttttatacttcgctgctcccaaatgagcaccccgagagaagtccaggcttcatgtacttgcccaggaattccttgtccccggacccggaatcacttggcctaattccggtcagtctgccttttcatttctgcaggtgatggtcaaccagtccccgtactcataggccatgggacacaagattattattatcatcattatttttaaagacagagtctcactttgttgcccaggctggagtgtagtggcacaatctcagctcgctgcaa

SEQ ID NO: 16357 - DNA, 1169 bp, Homo sapiens
gtagttgtttctccttagttttcctaatggttttagtttctcagctctaaaagctgtgttgaagaagagattgataactcttcctcttttattaattcaaatgaaacttcttacaaccaaccaatttagtaattacacaaatttttcttaaacatttactattttgagagtttcaaaaaggggagttagacgccacatttaataattctttggttagaacaaggtattaatattgtgtgtaatacattttctacaaaatattttttcattaaagaataaaaggaaacccctgatgatttaaaagcctaattttgttttgctttatatgtgaactgaatgaattttaaatctggaatcctgttccctattgctaataaattgttatgtagacatttgtttccaaaacggcttgtttttgatgttggtaacatcattaaaaagttttttcttttaatttcctcttccccatcatccagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatggttagtaggaggtttattattcttttttcccttaatattattactactatttttgctttctgtcctttttgcctctaagagcagtctggcaggccttctcaagtaaataccaaccctgtttctgcagcagcctcagcagcagctcagtctagacagggtttccttctttctgtttatttttcttgctatcagagccctgatgtgtacattttggaatgctggagtagctgcttcatttctattcctccatctcccctccctcattgaaggggctggtggaactagaccagatgtctaacaaaccccgattgctagagtgtctggctctgtacgtgactgaccaatcataatacggtgtgccaagttttttttatacctctgacaacagcgtacaaaacctggactgtttcttagcacaaagatttttttcttttcggcctatttaatggtgtttcctcaagctctccagaccagatgttctgtgctgtatcagaactgtaggcaatttaacagctttatagcctt

SEQ ID NO: 16358 - DNA, 1222 bp, Homo sapiens
ctttttgataaaacatgtgatcccttacaaaattgtgttaaccatgagtcatctgttatctccatagaaattaacatacccttatatagatggctaataatacaaagccacgatggtttctgtggttttactaactgtggttccatttctaaaacatttaaaataagacctgctcctttttaaaaaattttttgggcaaagggttgtcttatcagaaagtgcaataatttaagcagatccataactgggaggaattaataacagaaagtttttgttgacaccaggaagtagattaaatagtgcaattgtggtaatgagtaccatatatgataagcctgagccagctgggttatattaggctgcttgatactttgatcacagtattatttcaaggcttgtctatttaaattgctaaggtttcttgtcatctttgcgatttagaccataatttcttttattgcaaaaaaaaatttttttttttttttaaagaaaggccctggctaaaccaaaattgttaaggaggtacaagttcaacagctaggcaaaccttagaactagaaaacctgttcaacataaaaaaatggaaagcttagaagtacagcagttgaatattaagttcatctgaccttgcttttctttagttttttgcttggatcataattatcatatggtagtgagtaccataaggatgtttggtataattcaattagttactgtttgatataaatatgtgcatttaaaatatatatttcatgttttaagaataaagtactgctctcagtttcccttcagctggtattaagtggttttgatgaacatctttgagaattcggaaagatttttaactactttacccatagtgaatgaattacactaatcacagaatttaatttgcttgataaattatctcacttggcctttgaacttgaaatctttaaattttaattagcctaatataattgaatgaaatttatagtcatcaatatcagcacttttactaattttctatactgtggaatagtcttttacaggtatttattggtatctttgttatgtatttaagtgactgctttgtcttggaaaaatattcattttgattagtaaagggaagactatgaaggtttataattttaagatactgttgtccttagcatagtaataataaataataataataataatgaggtgacattttgaaaatttacaataagttgctttgtac

SEQ ID NO: 16359 - DNA, 1145 bp, Homo sapiens
acgtgttcccgttgttgcatcctctgactatggagatgatctgttgagaaaggcaaaatgagaatttatcagaaggctctgctttcaggtgtcccgataattgagacctttatctctgtgtcttattgatagttttgtcatttatgtgtctattaacaggatcactttctcaataatagcctcaggttgagggggtattctttgatttggctgaaggaactcctggatgccagaccatggggaagctttgatttaagagcataactgctgtagatggacgtttttgacatgtaatcaaactcctggagtttcagatctgcgtttagattatgtgagctttattatttatgtaagggtaaaggaaaggatttgtaagacatttatttattcctcttatttaatttgtggttttgcaaacctagtacagtttcttttgttttttcttagaaataaaggaaataataaactaggatggttgttaagctcccttctgtgtgtgtatgttttaggtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaaggtaagggtgttcatcacaagtgtgtctttgcagtgcatacaaatggatattgacacaggtctcaccataacttttgataatgtgtgaattgggaatctgtcaggctagcctacttcacttgatgtctgatactttgggaaaattatataaattctgggaaatgagggtttatactatagacatcattagtttggcctttacttatttggaatttgtgattctgatttgtcatagattggataggaactgtgctgatgttgactttgtcaacatgaaatcagcttgctaaataaagttttgagggacaaagatcatccttatgtgtctgttatccattcccttctatcctcttttgaataagtcagtgtttagaaagagatggagttcaattttctgcttcagaaagaagatactcctcaagcatttcagaaattttatttttgtactataggtgtagttcctttgttagcaaaggctga

SEQ ID NO: 16360 - DNA, 2170 bp, Homo sapiens
tatttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttacattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgtacttttttgagtattcattattcagttggtggtggtccccaagggaaagttggctgaaaaagttaatagagccaaacacttcgtttgtttgccttatctagaatagttatccatacaaaccaaatgaatttttcaaaagaaagaggtcttagactaaaaaatggaagacagactagcttgtctccaaccttctttgttaacagaactaggtgatctgaaattttaataaatatataattgttatgtgtgaaggtattaagattaaaaatgaaaccaacaaatggctggtacagaggaagctttggggcataaatatatctctgtaactgctaagtacatacaaactgacatgctatgtgtgtacatccttggtgctccaaacaagctaggtgggtaggcaggtgc

SEQ ID NO: 16361 - DNA, 1139 bp, Homo sapiens
gcattttgagaatatttttgcaataccagccatatattcttcattttcttccactaaaatatcatcagattcacttttttttttaaactgtactttgtttttaacttcttggttgaggtcagcagcatgctgcatttatataatagtaatattaaaattgtaaatttttttttaaagttacacttcaaaaattaaaggggaaaaagtatttcaagtcagagggtttatcacaaagtttttctaggtctgttttatagcagtgaaacaggtatgccaagttgttaataaatgggcatgcattgctcttaaattcttaaaattaaacttgatcagttgtgagggacagcttatgtctatgcattgcctaaaaattgtttctgtttgttggctttacttatagaaaatcttgatttttttttcattacttgatatttttattctttgtttttcctgataagctgccaaatggtgtcacttaccacactggaacatatcaagaccggttaacaaagctacaggataatcttcgccaactttcagttctcttcaggaagctgagattggtatatgacaaatgcaatgaaaactgtggtgggatggatcccattccagtcgaggtaattttttgtgatagagggaggatgaatataaggtgtgaactagtgtcaagacagttgttaatctttttcctctctctcctgttttagcaatatttccaggtttcgaattttattggttttacttttgaccagagaagatgaaaatgtgatatatatgcataaaatactactatatttttacattaacaatttcttgtagactttgacaggcttatagtaatttttgttgttgttaggaagaaatgttttcctatggcaatttttattgctgtcagtgtctccttttaattaagtcagggatatttttagtaggaattttaatagtatcatatacttttaaggtggttttcatgaagtactttacagataaaatattatttttattattattaatttggattttatatttagcccagtggaatcactatattttaaaaatatattctctaaatttaatcttgggtcatacctatttagttaattaggcatatatttctataagtcaccctttcctgttga

SEQ ID NO: 16362 - DNA, 1186 bp, Homo sapiens
agcctgagggttaagttacaccatggatgaaaagctgatgcatggttctaacttgcccgggcttgatattcaaaaaatgtctattccttttccattttctctcttttccaaaaatcctcttgctctgtttctgttaagacccttttgcaacactctgttttaacatggtgcttaatatattgtcagaaaccacattttccagtgcatatggtgcagtttttaatttctaatttagctttttaattaaaaactcaccttttgctcctaatacctataggggttggtttccaattctgcttttctggtggtaactgaatctctgttctcccagtgatgagtgtaaccctctgtgtacaagtaggaacatcatgactgccatgcttgggccattggtataattatttctgctacctctgaagactgtggtgagggtagaatcagagtggtccctagccatcgtcccccttttgaattggtagtcatcttgaatgtcacagcagcctagacttgtagaccatatcaggaaagtagaagcaagaattctgtcgtgtgctactccactccaagatgctgtaggtcatcagaagctctgtgacttcagatgtgcaagtgaggccaaggcactgtcacattaatatctgtgtgatctcggtggcattgtgcttttccatcattgtcagggctgctgggctctctgtgcctaaaagctgcttcaaacaagcagctcacattccagagctctgagagatgttgtcagcctttaacagttttctcttcgagaagacattagattctgtacaggttgcagaaacgttgtcttaaggtggctggaaggaagtgtttgaaataacacatgtgcttgtgattttggtaaccaaggaaacatgtacctgatacaaagcttcctttaaaaaatgatggtacccttctgggattgcctcagaatcacccacagcaagattccaaagggatttaaaattaaagtaggtcacttccagcaactgtatcaagagttaacagagaatcacctctttaaaaatgaagaatcatctctttaaaaatgtactgtttagaagaggaacccaatacattgtggatacaatatgctaccatctgaataatctgagtcttgcttataatggatgtttaataagtcttacctggattaaattttcctctgcttctg

SEQ ID NO: 16363 - DNA, 1201 bp, Homo sapiens
ttttaattgtagtgaatgtgaaagtgttgttaatgaaaatataaagaatatttgttaaagtgtggacctagccaggaatactaggtagaaaaggtaactctttaaaaacatttttttaattgtgaagttaatttattgtcactttgtttgatatttattattagagtccctaggttaattctgtttttattgcttttcagaataattaagacctaaatcttctgccgaattctgtttggtttccttatttcttttgccatgttctttcattccacaaatgttattgagcacttccagtgtaccaagccttgtgtttactgctttgatgataaatgcaataaggtaatgctgcttttaaggatccttcaggataggctcttgtagcagtaaggacttagtatttttgctatagaagtgtatggagagctatctatggtgcaataactgtggaaatacagtttttattctatttggttcccatatacattgagtcctcctttggtgggaatttgatcaggttggtctcagttgaatcctggctgcatatgcctcagtaaggaagaaggcctaggggactgtggaaagcctggtggtggtcctggaaggcttgagaatacctggagctggaagctccttgctcattggtgacctttttcatatgcagcagagctcttggcattcctagcatactaccttgaaaggactgtgtcttgcctcctagaaattctggacttggtagaatcatttgtttatgttattttaaaaagaaaaaaaactctgaaatgtactttttggaagaaaaatgaacttgtttttggacttttctgtgtgttgtttctttaattgaaaattctgtctggagattgattttcaacccccttcctttccctctagttttaaattgtaacattgctttccaagcatttcaaaaaaacaacaaaaaagaaatattttattattactctatttttatttgctcattaataattcttgattttctatctatatgaaatcaaagaaaaattactgtataattttcatccagttgcagtcaattctataactgaaatacaagataaaaaataagtaattgatttacttaagaaacaaaggcatctcgacctcctaaaaatttcatcaaatattcactcggcagacccttctttgtaataggagctcacttactattgtgagcactgac

SEQ ID NO: 16364 - DNA, 1227 bp, Homo sapiens
aacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattcttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccc

SEQ ID NO: 16365 - DNA, 1163 bp, Homo sapiens
agcatgagctttgtgggtaaagagagctcaccaaattcagcctccagcagcacacacagctcagtagcagcgccccgcccagatgtttatattttcctccatcggccccgccccccgaccatgaggggctctagccacgcccccaagctcaagtttctggggccggactagcccagcgcgtctgcctacccatagggattccctctccagccaatccagtcagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggtaaggcaagagacacagcgggtgagctcacgatggcactgccaacgcgtgcccgctgcagtcctgcgcgcacgcgctccctggctcgtggcttgcgactcgcgtggggcgccggaacggctgcgggcgcgtggatggtcctcggtgcgcccgcgcttagctgctgcagcctcggtccctgaggactcgctcgccaagcggggctgcctggcagaagccgacgagcgggtggtgcgcgctgcgccctagcctggctgctgcagtcctgtgccgggcaaagtccctgccacccaccgcgctgtccgtcttcccgtgtacctggacgccgccaggcctcccggctgacagcctgcgcctcatccgcgaagagagcaagaggggtcgctgtggggtcccgaggcgaccccagcccctctactccttgataaaaggagcaagaccaacgatagtcttcactaggttttcctttttgctgacaagtcttccttcactcccctgagcctcggtgttttacatctgtaaaacagggctgattcaagggctttttgtgaggttaaactgagagagcatttctgaaaccctgcacctatcagttaattggcacatcgtcctcaatcatttgggtccgcaagggggcgtggaggcaccttgtcgggctgccttgaggctgtgccaactccccgggctcgcacgttttgg

SEQ ID NO: 16366 - DNA, 1164 bp, Homo sapiens
tctaaattgcctccttagcctgaatttttactagctttctagtgtaacatattctaaggacatgacatgctgcttatttggggggattatttttcaccaaaatgatcatcttgtgttgtaacttttcagctcacttgtatatacgcacgttttcatttttggtctagaaaatagtgcattttggggctcagcgtgcagaggaaattcctcaaagtgccaaattaggcagtcaggaaatactaaattcttcattccaaataatggatctgaatgatgacgttaattttttatcatgcattaacaaaataaaatatgagaattgtaccacagccatttcttttcattaggttatcgtaatgtataggtactggtggaatggacctaccgtgctaaatatgttatagacatatatatatatatatatatatatatatatatttctggtaatccaacttttctgatttgtagctttagtcagagaataggattttggagtgacagagaatgtctaacagtaatactgttgatatacatttgagaaatactatcacctctgtgtgggtgtgcatttgtactgtatggcaggctctgtgcatttaatatatatgatatcctttaaccctcaatgcaaccttgcaaggtagatattaacgtccacatttttcagatgtggaaactaagcctgagcaagttttaaaatggtctctaaattcacacggctgcaggaactactaggtgaaataggctgaatgtaaacacaggtttaacgctaaatcccatgttactcccctcaacttttccccatttaaggaccttatattgagggtttattctgagccaggctgtatgctaagactttacgccatttgtccttatttacctgtgaagtcaatacggtcattatctccattttacaaatgaggaaactgacttgtaaagtggttagtcatatgcccaaggccacaaaactaataaagtgggaaaccttaccactggcttaaaaaaattttttatagcatctttaaaagatgagtcttaaatgctttctgtgctcaggtattcattaagtgacaaaagaagaaggaatacctttcgagaaatggtatctccttttgagaaatggtatcttcttcttgcctgctttacccattatcttggaccctg

SEQ ID NO: 16367 - DNA, 1179 bp, Homo sapiens
taattttataaaatttaaagttttgtgaagttattttttctcaggatccaatgatgatgtcagtataattggttttcagagtgttttattgtcctttataaaagagacatcatttatttgaacattacagttttgcacttattcattctcttttggataacaaaattatgtttagaaaaatataatgaaattgcacaggttttttttttctctgttgagtacaatagcattgatgatcatgagagtgatgtgtgtaattaaccactgctgcagaattggcaagtaattatgatatagtttattgttttctagtatatgctagctatttcaagataacatggctttcaataaatgatgaacatttaaaaagtttgaattcctaagggcgtatattgttttggagaatttcagaaattaaaactaaaagcttcctttgtcttctaaataaatataaaactaatttttctaaataaacataaaattcagttcttcagggtactattttgagacatttcagatctaactttttaaaaattacaaaaatgcctttttctctttctaggtagagcaatggtagatataatactgttgctttctgacaaagatcctcctaaattgaaagactatttacctactgtaggagcattaaaacatttgagagaatggtattcagcaaagatcactatagcaggaaatcattgtgaaatgtaagcttctttgttcatatttgattattgtctgccttgtctgttttcacaattaacatactattctcttttcagactcagcgtttgaaaattattttaatatgacaacataaaattctatgttataccatgattgcaaatttgtgtattgagaagaatctagatgtttcatattttatatttatgtttctgagatatttaagtttttagtaaatattattgatgctgttttacaaccattattgaggattaattctataagcacactgtgtgcttttgaacatagatacactggatttgtcatgttgtatttggttttctgttatgtgccaatgtaggaataaatatacactgttgtgttttatgatattctagcaaggattaattgtatattacaattttgatccttaaacattcagttggatttaataacttcatgatttgttttcattcaacgaatgtttattgagca

SEQ ID NO: 16368 - DNA, 2028 bp, Homo sapiens
taggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaaggttgtctgtgttaagtttccatgtccctgctctgctgtctcttagatatcacataatttgtgtaaccaattatctcttgaagagcatttaggaagtacccagtattttttgctggattaattcctggatgcagaattcctgggttttcattttaatgaaggaggatgcttgctaactttgagtgaggagtcatatctgattgtagcatgctttatggcatttttatagcttctacccatggatctgagccctggaactttataaaattagtttaatcctgtttcctcataaggcacacacagactagatagcaggtgccatgacattcctgagcccttttttttttttttcctcgagggtgaacatcccagtctgtatcttgggccttcgacaggccaacttcactcatcacaaggtgaggtgacaggaagcaggttgtatgtatgtccctcttctattactggggaaatactgaagcaatagaaaaagatcccgcttatttagaaggacacattgccagtatcattgtgttctaagctaccttttgaatgacatggatctaataataggcaatgttgcagttgccaacatcttcgtttattgccaactctgtttctgaggtccctgcccctcttacactttcagcagtaacttaacactctgaataactaacctttgaaagaagttactcctttctggactttatactgtttttttcttagaaggctgggctgagcaaatggg

SEQ ID NO: 16369 - DNA, 1104 bp, Homo sapiens
atttgcccctgacgggaatcatgttgcaggtgaagacaaagaggatttgtaatagtaacagtagatctatacactcttgaggtgacctgtatgtaagccaagggaaaactgaagaaggtcagcgttgatttcagggtgcaagtcggctttcctaagtgatctctgtggtgtcttacactcaaggatacaagaggcaagggagaagtgcttaatggctccaggaaagggggaacaggcatttattgttcctcttttccttactcccacgcttctctcttggtagccttcatgtttgcccacattttataaatacaatattcatgactgaaagcattcagaagcatgctttgcaacttccccaactcttgaggcaggaagtagcaaaaacaatattttgaggatgggctggtgcttgaaagagaggtcagaggggctgctggccttgaagagtggcaggcctcattggttcagcaggactgatttcccgtctccctcagaatgcatttgccactcagactacaaaagtgctcattgtcagctctcacagactcccagggactaaatgggctgccttgaaggctctcttccttatgctattagttaaaacttggtgcatctctattgcttgaatgtctttaaactcatttggctctctttgcagggtaatcaatgagcttattggaaatctggttggacatctttattttttcctaatgttcagatacccaatggacttgggaggaagaaattttctatccacacctcagtttttgtaagtgtttttgtcctgtctcatctaacattttactgcctgtgttcttagtgcatcctaatgagagctccatgaggagtatgatttacccctatgccccatctgctggagaaacctgaggcaacaagtgacttaccctagtcacacagtcacaggaagttagggattaaagcttaggctcagttgccttcctgttactcttttagccagggaccactgacaactagattccaacattacaggaggcatctcagctctctgagcctgctgagggacctgatgcaactccagagtgcgaaacagtaggctggtgaatgggcagagtcacaggt

SEQ ID NO: 16370 - DNA, 1750 bp, Homo sapiens
aaatattgttcaatttaccaaaaaagttaccaaaaccttcccaaaatagttattacaggaagtgaggtacatatatatcttttgcaccttgtatagaaatagaaaaaagtacaagtctttagatttcatagtctgcttattacagatactgacaatgaaatatatactccctgctcatacagtttgaaataaattattacataaagatgataaatgtttataagcaaatctagcatatgaagaacatatacatagatgagttgcacacaaagcctagtgtattatggaagacatatgtggcaggtaatctcaagagaatacaaaagatgtattttcacttttatttctaaaagtagtaaaaattaaaatatggttttctttaaattttcagttttttatgatgtttttcttttttagctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatt

SEQ ID NO: 16371 - DNA, 1224 bp, Homo sapiens
tatttttttgagacaaggtcttgctctgtcacccaggctggaatgcagtggtgcaatcttggctcactacgtacaacctcagcttcccaagtagtaggactacaggcacaggtcatgtcaccatgctggctaatttttttttttttttttaatagagatggggtttccctatgttgcccaggctggtctcaaactcctggcctcgagtactcttcccacctcagcccccaagttctggggttacaggcgtgagccaccatgccttgccttttttttctttttgatgttatatattgtttgagaactcttaagttcctttgtgaaattatgctttataaaatgtcttctaggattcatttgtggggggtctaacaaccgtctgttttccattgatttcaatttctgtgggccatttgggatgttattttatagatttttttaatccattggaaatagtgaggtgccctgagaaaatttattcacatgtaatgcgttaaatcttacaaaagaagaaatattactgaatgatatagactgtgttcatagtattaatctcttctctcttatttttaaaatttagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggtaagaatttaatgtcactcaaattttgacaaaatatattgctgtttattaataataagtcttggtatagtaaaaatttggagattcttgagttttgtatcatggtcttgtcaaatgatagtaaacaactcaaatggggacaaatttttattcttttctttaaatataataatgccttcccaaaattactcttaaaattatttcaatttgagtgtagcctttggatgttctaagtgttgcttcagaacatatggcttaatgagtaatcaatccttagccagtttgttagccttgtctttttcatgaatatcatcatataatcctaccgagtttttttaagtctacttaatcttctgggaaccaaagaggaaaatatgtcaagagctgtctgtactcttaaaaacagctcttaatatgcaccagaatgaatagctactttagtagttacttttctcttatttgtgtttatgacgaatataacttt

SEQ ID NO: 16372 - DNA, 2996 bp, Homo sapiens
tttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtattttttttttttgatcggggctctttaatctcattttaatttcctttgtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtattgatcaagttactatgaaaatgtgtttaattttctgaaagttcctgtcttaattttaaatacaaccatggtttggtgctgtggctttcctgtacttaaaaaaaaaaaaaacccacaaaaaacttaattattttgtagtaatttcagatttacagaaactggcaaagatagtcagatgttccctgtacccttcactgagcttcccctagcgtggacaccttctgtaaactatggcaggtctatgaaaactcagaagttaaccctggtactagtattttctaaactgcacacttgattaggcttttaccagttttcccactaatgtctttttgttgtcaagatccagtccaggataccacatcgcatgtatttagttatcagtgtctcattagtctcctccaatataacattttc

SEQ ID NO: 16373 - DNA, 2568 bp, Homo sapiens
agtcatttcttaactgtcacatctattgaaaatggatatagatacaggttttaagtattttaagtatatattacttattttaattttctgactttactattttaagggccagagggttaatcacaaagagcaattatgtggtctccctgctacatgaaaccgtgtatactaacaagcgtacaatttttagttgattttttttaaccttttagtttcccagttttgaataattacatggtggattctgacttttgaggggaagcaaatgattattttagagtctttgaaatggggattgtggaattagattgaactaagggatttaacatgatgcttggaaattaagagactaaagctttttttaaaaaaaggtggaaaataggaactgtcaagaaggtttatggtataaatgatgaagttgaagtgatgtttgaaagattaatgagatacaatttatattatttggtaaggtttttttttttccctccaaagatgtcatcttctcatctgaatggaataagtctgaataccccatattcatactcctaatctcattatatcttatttagtgaattttatttatgaataatttctgttgaagtgaaaactagatatttaatattttgcttttttgctacatagtctactcaaaaattacatgaggagaaatcctttttccctttgtttttcttttttcttcttttgtggtatttaaagcatattttaggttgaagttacttatttctagtcttgtacttctggcttaagtataaccatgtaagaattataaattttagttttctgaacccttaaacttttttagcatgtggtctgttacacatgctaaaaaattagtcttacttgtaacagcgtaattaaacacatcatggaggagagaaacttaaaattaaaatagtattttggcttttgaagttatttgtgttgctaaatagatgcagaggttttacagcagtttattttaaggttttatttatacataattactttgaactcttcagagtagatattttttcacaaggcagtttgtcataaattctctcatgcgcttcagaatgcataagtgccatcctttaatcatagactttgaggagagaaagcataaaaatatagcatataatctaaaaataaatatataacatgcacaaataatgtgacattcttactgaatcaaatcatgattctagaacttgagatcttaaatagaatttcggtttgtatcttccatataataaccacacacagataaccacacaaaaaatcctttgtaaaatttctgattgataggattagagtgcttaaatttttggggggggaagggtggggtaaagtgtaagtgctttcttttgtccctaacttgtgtattgatggcagtccactctgttttctaaaaatgtattttactgtggtgcttaacttcttattaattaaatcccgtatcagaaaccttgcctgtgactttagaaagggcttttgattattgttttttcttcttgctcttgaaagtaatctggtcccagggaattactggtttaactgaacatctccagaattatttaaggtgtcaaaatatataaccttcacattgaaagataattttaatttatgggcataataaaaatttgaatcattcaggtaattttcaaaaaatggagaccatttgtctttaactgaaggtatatgtttaagatcatagtctaccctagtatggtgctttgccacaaagtgatttctgaagaatggttctttttaagataatgacttcatatgatcattgtttcatgttacttgccacaaataactttaatttaggttgaaactggaactgtttgtttctcatattagctacttctctattaggagcacaagaaccatagttaaatgcaacatgagctactttagtcctgtttgtttaaatttgtgttgtccatgtattatgatttattaacttgttgatgcatgtaaattgggtgcattttgttgccatgtatgttaaatggtgaccaatgtttttacaaaggaattgaacaaaaaaagtatcttttaagaaatttggaatgtggttttgattttgaaatttgatttcttactaatctcagagggccttggtatattctgttactaaagcaaacaggattaatgaatacggatttgttacaaggtggcagcaatgtcactgagatagtgaatggaacaatttaccacctccctggaatctgcacctgagatacaacatcagcgtatgagtgaagagtgagcccatagaaaagctttagatagactcacataagtcacactgatgggtatttacagcagatatatccaagctgtttatgtaatagtctcatttactttattctttttctctagaacataaattttgaaggtaatggaagtttatcttttataccaaaagtttgtatgagccattttgaagtaaatctttctaattttagaattatattttctcgccatcttaagacagtatattaaatataatataacctttttcttagtggctaagcattatctttatgtatattattattg

SEQ ID NO: 16374 - DNA, 1222 bp, Homo sapiens
cttgccttttgagactcagtgtttggttatatccctacttagagtagtatgcttctttatgaatgtttaggtggtacatctcttgaaaggatcatgaagacctgaactcattttttgtaacataaaactaagacccagagggcttgtaacctgctgaagatttagtgactaattatatatcagagtaggtatttgtgttaggtcttttgggtttttagttcggtgctgtttttcactctaatacatttcttcagtgttagcagtggattagcctcaggctatagggtatccagttgttttggaaccatgtaatagtttccagttgttctgaaaccatccagcagaaaccacctaatacctccattcaaaaaacattttatttggtaactatgatgtatcatttgattttctcctctttattttaacttcaatttttttttaaaaaaaatgtatctgaaggggaattacattttatgaggggaaaaaaagcaatttgaaaaggatattagtattttagctaattgcagttttatttcaatttcaaatactaatgaataaccagtgttttgacaatgttttatatatgcacatacaattgattcttggttcttccatatttttctattgagaatttattaactgaatgagaagtagaatgggaaaatgagaatctgagttctggacctagctgtgtgtctttgagtaagtcacttaacatctgtgggcctaagtggctacatcttcaaagtggagaatgaagtcagtatttcacagtgagtgtgcttctggtatttgggctggataattctttgttatgaagtactctgttgtgcattgtaggaagtttagattccttaatgctggtggtagcatttcccagtcattatcatatcccagacgaccctgcatatccaaacctcttctagtggggagggaccacttcatattgagaactactggcaaatggtctctaagaattctttcagcttcaacattctgtgaaagaattcttatttggggcatgattgaaaaagaaggtaatatatcatacaccgaaaaacctctgctgcttcctggatacgaaacaattttattttaaaatgaataacttttacgaatctgtgtagccctactcacagatctaccatttatgatgttccaagataaattattttattctagcttgccttaggctttttctctacagtattatccatagcta

SEQ ID NO: 16375 - DNA, 1193 bp, Homo sapiens
atggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgc

SEQ ID NO: 16376 - DNA, 1176 bp, Homo sapiens
actaactatgatatgaacgaatgaatgcttgagtgaattggtccccagaagcggtcagcctctccgccaaggcagaggggaagggccgggaggtgcacgtgggatgaatggaaacatagtgattggcctttttggagttttcttcttaaaaaactgaatacattacagatgttgaaaacagcacaaaaatcataactgtacggcttgttaatttttacaaataaatacaccctcgtgaatccagaacctagatcaagaaccagagcattaccagcacccagaaacctccccgcgccctcctccactgagcggccctttcaacccttacaatgccggagggcgcaattcctgggtcctgtgaccttggtgaccgacgcccgggacaagtcagaaagacccaagggcgtggaaaacgctcctcttaccgataaacttgaagcgactcatgactgcgcatggaggacctccccagcggaagcggaagtggccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagaggtaagggatggggacccaggactcggggaggtgaccctcggggccccatggaggtggagaggcccctgggtacctggaggttcaaggacttcgggaacggaattggaaggtggcctctcgcttcacagaatcctatggtagacccgggttcaaatccaggcttcgccacttatggccgggagaccttgtagagttgcttgtcgggtctgggcgtcagctttttgtttagtaaaacggacgcacgaccagcgcagagggtcgcaggaaaattaagtgaaataaaggaaagtgcctaaaattgtaattgtcatgggtccagcgctcgctcaatcgttttcttcacgatcttctcctttccaatattaacagcaataaactatgcattattttcttcagtctgcaaaactctaggagttaggaattatcttaagcttattttacagataagaagatgagcacagctggtaacttgcgcaaggtgatagagt

SEQ ID NO: 16377 - DNA, 1395 bp, Homo sapiens
cacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaaga

SEQ ID NO: 16378 - DNA, 1149 bp, Homo sapiens
ttcccaggatatatttgaagaatttagttattaatgatacagtttgccctataataagtctttgaagccccttataaacatttattatattcggcccagtgtggatttctaaatatgtctgtataacattttccaaatatcatgtttagaaaacaataaatatttaattttattgggataatatgacacacttttatttaacgaatattttgatatcattgatttttatatattatctagattttaaaatgtaacaatttgtttggtttgataatatttagtatctagctttagcctaggatgcaaaagtccagtgtgtccacatagcggtagcatgatttgaatctaacaaatttggatacctagtttacctttttttttttaaacagcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggaggtaggttcatattgattttcaggagagttacgtggtatgaacaagcactcttcacttagaccatcctatgaccagtaagaaggtattccattttattttcatttataaaattttctatactcatttaccaacaaatttgcatgaaagtgagagcaaaggataaaataagcatttaatagtatgattagatgtgaattagacttaatgagatataataaaatggccaaaagattgtaatggtcaaaattaaggactggaaaatcctagaatgagggcattaaattttgtgaaaggcgaagggaactgtcatttgtagagggtatgttgtatacttgttacagtgttattacttagaatcttttatttaagcaccattcatccattcaaccagtgctttttaagcactggctattcatttaggaaatatttatgcactgtctactttgtgtggggatggggtggtggggtggggtggggtggggaaggtgggagagacacaaagaagca

SEQ ID NO: 16379 - DNA, 1220 bp, Homo sapiens
ccagaggcaagaacattcctcgcagatcaaggtacctttaagagccaagaagctcagatttggaggcgggagagctgtactgcatcccctcaaatgttagcagtgccaagaaatgagacgctagtctagggggcaccacaagcagaaaggggctgtttcaaggagtcgtccgcccatgggagtctcctcttctattattcaccttgctccaaggatatcttttcttttacgtatgaaaattttgtaattgttcaactataacaccatgaataatttaattctttaatttttcaggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtacccaaagtcgtctcgcttatgattcaaaaactgtgtattcaccctgtaaaaaaccctgtttggaataagagatgactctgctaggtataatagctcacccccaacaagctggcaggcacgtggtgatagccagactagtagcaaatgtagtggccacacaatctgtgtcatgtgccattgaagtttcttggtgtctcatcatcctcttccaatcccacatgccctagggggtccacagcattccttctgtaggactccttaacaaagctgctccttccggtatcttcctcagcaacctgagtcctgccccaagtccccacaaccgtatcattatccagagtcctttttggtaatagccttcccataagcttaactccctcgaaatcctaaatcatttctgcatgaaaattaccctgaaaaggaagctgccactattagtctgttctcacactgctatgaagaaatatgggtggggacacagagccacaccatatcactgccatcctactgtggcaact

SEQ ID NO: 16380 - DNA, 1205 bp, Homo sapiens
atccccattttacagaggaggatattgaggctcataagaggttgagcaatttgccaaactttatatttacaattcaaactcaggaaatcaagctgcagagtccatgccctttactattacgtaaactgcctcttgttgattgactttattgaggaaaaagaaaaaatcttagaagttggaggaaatgggaagtcagtacagcaatgataatgtgatctgttttgtaggacattagattttttcaaattagtgattattttggagtacttttgctaaagtctgtgtttctaaaacaaagtgccttcatccagtgggctaaatctgagaataatttatcacatatttggcatatctttcttaggctatatgtgctaatccctaacatgagctgagtttgagaacttaatgtttttacatattacctcagagactgaaatcagttcttaaaccagtattgggttttgccattcagagaggcactgtggggccatgccaagaaacaaattagctaaaagtaaggctttccttcagtcgacagcagtgggtctcctttcatcttgtggctcttttaagctctctaacaacctctttctgtcctttcgactccattcacctcaaacccaacagttcttttttgtagtcaacactgctaaatagttattcagagccctgcagctctcatttcattcttggctttgtctaagttcctgagagagctgcaaaaagaggttgaagaagtgaaaatcatcagctcaccctgtttgcatatcctgcagtttgccagcaccccctgagaaagttcaaagtctaagggtacagtgagcagagaagcctctccagggagattcccaatagcttgtttgtttcacattgtgctctggggtatatttgtttttattcaggaaggtattgcctttttatttcttgatatattttataagaaaatgttttctcttaacatgagagcaaattatacttatttgctgaacaaagcaaagctatctgcaaggacattttagttttcacttcaagcatcattgcttttggcaattgtagacaaattatcgtactgtttgatgaggtgtaaaataacacgctttaactggagaatgaacacatttccagatacaatattatcgttctcttctttttcaagtaataatttccaaaagatgaattttaatggactttttgccatttaacca

SEQ ID NO: 16381 - DNA, 1251 bp, Homo sapiens
ttttcctccgccccctccttcggcttctccgctgagctgggggcctgcgggagggcgcgcgcgccgcctcctgcccagcccctcccagccctgggggcgtgtgcgcgcgtccaggccggcccgggacgcaccacctgcgcccgagcgcgcgctgcccggagcatccccagccctaagtccacccccattccccccacctcctactccctctccccttcccccagtctcctccctccgctccggagactgctcgctgggcggcggggccggagtcgtcgcagccacctcattgcacaacccggcttcccaactgtttacacagcccggcctgtgagtgtgtgtgtatacagcgtgagtcaccaggaggcggaggaggtggaggaaaaggagaaggaggagtgcactggccgggatcggtgcagcgctcacactcactcacagtcactctctctgagcgcgtctcgctcgctctcatacacgcccggagcccaggagcgctcaggatcccgagcgccgcgaaaaagttcccccggcttttgctggagactcatcgctttgggaagtgcatttgcttcgtggctccgccgagcctgctgaatcctgtcctcgcggctcgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgcctcccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgac

SEQ ID NO: 16382 - DNA, 1300 bp, Homo sapiens
gtacatctgaagtagattctaaacattagagtattaataaaaatgcatagataagtgaagtgaatcctcaacgtaaaactaccagcctagcatatactggttccagataaaagaagtaaagttgcaaccaagttaaagtttgaaaatataattaattatgactgataacactatactgcttttatctaacaacaagcaaagcgaccccaggactctgataaatagaaatacatcatggacagtgaaaacattaacaattctggcgtttgtgttgtcatctcttatagcacctcctgtttccctggcaatcctcagaacccagacaggagcgtggccccatcagtgcatgctgaagggcgaagggctggtaccgagaattatccatttcaagcagaaggaaaatggaccagttgtggtgttgggacacattacaggattgcctgaaggccagcagatgccatgttcatcagtgtgcaaataatatacaaggctgtaccagtgcaggtcctcactttaatcctctatccccaaaacacggtggaccaaaggatcaagagaggcatgttaaacacctgggcaatgtgactgctggcaaagatgatgcaatgatgtgtctattgaagattctatgatctcactctcaggaggccactccatcattggccatgcaatggtggtccatgaaaaaccagatgacttgggcaaagatggaaatgaagaaagtacaaagatgggaaatgctggaagttatttggcttgtggtgtatttgggaattcccagtaaacattccctaggatgaggtctgagtgccagtaacacatgtgttatcctgctagctgtagaaatgtaacttgataaacatttaacactgtaatcttaaaagtgtaaagaaaaaaaaaacacacacacattcacaattctccagaaacttcttatgtagaatacagttttaaacatgtttatgttaatgacattttacccacacaaatttaatctatgcaaacctgagcatctcttccgattggacaatgcttcctagacatcttgtcaatgataacatatcaaacaatcctaactgtttccaattcttgtcttttcccacggtgaaagaacacatctttgcaactttccagaggtcctctgggaaatctcaaaggcaattttgggcactgaggaggctgagaagactgtgcttgactgttagctgaaacaacttttggctgtttggcagaggactaacaggccctctgctttatgtgaatttctcactttaacttgtttgctccattttgggtgcag

SEQ ID NO: 16383 - DNA, 1113 bp, Homo sapiens
ctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctggtaagcgaagcccgcccaggcctgtcaaaagtgggcggctggatacctttcccattttcattggcagcttatttaacgggccactcttattaggaaggagagatagcagatctggagagatttgggagctcatcacctctgaaaccttgggctttagcgtttcctcccatcccttccccttagactgcccatgtttgcagcccccctccccgtttgtctcccacccctcaggaatttcatttaggtttttaaaccttctggcttatcttacaactcaatccacttcttcttacctcccgttaacattttaattgccctggggcggggtggcagggagtgtatgaa

SEQ ID NO: 16384 - DNA, 1177 bp, Homo sapiens
tgtgttgtctgttataagatgtttcagacctattttgcatactggcagcgacaagttgagacttgttcaacttgacacagtcctgtggtcatagcgaatctttctaaagctctgatcagtcaagaagggggttgtatcaatcctcagaaccctgagtggaactttctacaggatttattaggagaaaaaccttcccggaagctgcagaaggacaaatacagaatccgtgtctgggagaaacctcgtggcctggtctccattatttgagatgagttacatcttggaggtgaggacgtgcctcgtggtctaaagcttcggcacaagggcccaactggaattccacttacgggtatgactgtggggtatatgctgtacccattgaattcccagagggatttgttaagtggttgtgttgctgttttgcctggttaagagtggcttattcttgttgcctcatctatcttgagtgcagaatttttgcataaacggcttctcttgaaaaatagaagtccgtttttgttttgttttgttttttttctgattaactttccttttcctctgtcttaaacaccttcccccgcccctcgccacctccatgctgtgtttctgtggctggagcttttctgcactggaaaggaggagttctcccctctgttctgacatatctgatccccactagtttatatgattgctggtctgaaaacctggtgaattctcactgcccacatcaaatcaattccctgttctttagttgttttttttttccgcctcctgagcggtaggcaggcactctggctggattctggagcctgtgtttgccatgcctgggccttctgcctgcccaagatggacacgtttctctggcagctttgtcaagagatctcctggactataagacaccctgttctttcctcctgtttgtgtgagtggccctgcatttgggcagagtattggcagaatatctgggggaagtggaagactttggatagttgccggtccaggtcgtctggagaggcagtggcaggcctgctgatggctgcccctttgctatttgttttatatcaggtggcccttctggatgtgtggcctttttattttgcatttcctttcatagttggctgcagacataagattcttctttttctcttgttttgcttttttttttttttttttgaga

SEQ ID NO: 16385 - DNA, 1232 bp, Homo sapiens
aggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaagtgtggcttggtttactgatgttttgtttttaggcttctgaagttttccccatgtatgtttttatggaatgcatatatacattacatgattttttcttcttttaggggagagccgggtcttttcattagaattttgatcattgtctatgtatatacttttaattgcctttaaaattttgctaagtatattaagaccagtgatcttttcattaactggacttttattcttgatttactcttgtatggatgtagtaatggaaggaaaaccgcatccttgcttgattctccatttccaggggagcgggtagcaacatgaaggcagagtagccctttaatcatgggaagagagtgattataagagggacttcccaggagaaaagcagaggccatgatctcactagtggtagaaaactaacaggtttcagtttaagatcataaaacctaaatcatgaaatctaaatctcatggttggaacaaactacttaaaggttgtc

SEQ ID NO: 16386 - DNA, 1205 bp, Homo sapiens
acctgtaatcccaacactttgggaggctgaggtgggtggatcacttgaggtcaggagttcaagaccagcctggccaacatggtgaaatcccgtctctactaaaaatacaaaatttactaaaaatactaaaaatacaaaatactcacttgaacccaggaggcggaggttgcagtgagctgagattgcgccgctgcactccagcctgagtgacagagcaagactccgtctcaaaaaaaaaaaaaaaaaagaaagtcagtgctcttaactaatgtagtcttgtcaaccctataagggccttcacggaaaaccattgactcttggagcctgggtgccctctgtctgtgacagtgcacttcccttttctacttcttttttcccccggtttcctagactcccaactatcctcactggtgaggcttaaccataggatggggacctttggcaaaatactgtacagccatttctacgtaggcgtgcttttaacttttattttaatcgagctatcttacatgctgtaaaatgcacaaatcttaatcgtacagcttggtgaaattttgatatgttacacccatctaatcaccacccaaatcaggatatacaatatttctagaaaggtccctcatgccctttgcacttagtgttgccccagagataagcactattctgacgtctgtcaacatagattcatgcttccaccttggccgtatccaaatatacttgctcaacaaaagcaaaaggataaaacaccactttaaatagtgtaggtgatcctgtcattccacccaatgggcgtctctcttggagtgggtgtgaatggcagacatggatctgctattccgtctgttggtcatttgttctcatggctttttaggatgtgagcatcttgtgccaccaaatatgtttctcatatttatggattttaattatcacacaacatggcccctaaatctaagccagttattacatatggtgcccaaccctaagaaaccaaatccagtgctgaaggaaagactggctgtgttggacttcatgaaagatggtttgtttgtctccaacctgagaccttattgtgggatttttcaaggggaattttggcttctttcaattttcacacaacatgctggcttcagaagctaacccttgagtagatacaattttaatgtgggcagaactcaagtgtggataagtggttatattaaatttag

SEQ ID NO: 16387 - DNA, 1616 bp, Homo sapiens
taggctgggctcttacccactgggtttgtcgtggggccactgcctgctgcctccatcctgaccactctcttttctccctgcagattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgc

SEQ ID NO: 16388 - DNA, 1182 bp, Homo sapiens
ttcagcctctctgcgcttcagggttttttatctgtaaaagcggttattattagtatttaccccatcatatagttgtaaagattcaatgaactaatacatgtaaatgttaagaaacagtgtctgtcccataggacctggcactctaaataaatactgcctgttatcactgtattgcttataaatctaggttagaaacatcataattttctctattataataattaggtctcaaatttgactcagttgtcagcacaaaaataagtggctaatctatagttttaagttataaagtaagtcatttttttctaatcatcatctaatttttcagtgggaacctggataagcagacggccctgggaaacacagttctacactactgtagtatgtacagtaaacctgagtgtttgaagcttttgctcaggagcaagcccactgtggatataggtaagagtgtgtctagtgtcttcatgactgtagtaagcgtgtgttgcatggtacattgtaatttgattattgttccttgccttcttaaggtgtttcctagataattatgcaaattaatttttttcctatttcagttaaccaggctggagaaactgccctagacatagcaaagagactaaaagctacccagtgtgaagatctggtaagcaaaaatggacgtgggagatttattagacattggctgccttaaaagtgtcattctgagaagctagaattgaatattaaaaatgcagattcatttttttttaacacttgctaaagaaaatcagatgagcaatgtgctacattagaaaaagtggtaaaatgataaatttgtcatccacatgtttttggaatgcagttaaaggaggtgaaaggcattacacaagtattattaccagatcgacttgtgcattgaggtcatgctttttatttcccagaccattagactttctctgcagcttaatagtaaagaattatttgagaagctgctccaaaaattgggcaagtaaagctcagagagtagtggtcttcaaaatgttaacacactgttctcccagcccctccccttcctgtgcacattcaccttttttgaccctactagttcttgcttagcaagtcagggccttcacattagtgtgattctcttgagtttctgctaagtgccaggttccaggcccaccagttgggcctttttat

SEQ ID NO: 16389 - DNA, 1886 bp, Homo sapiens
ctgttgaaagggaaagtcaggcccagaatctgcctcccaactctttttttccatctctttttccactagggtggttgtatgctctttaggcactgttgatttctggctttgaatcatgatctcttcatatttcagtatgcatgaataataggacaatttcatgcattcattttgctatttctgagtagaagttagtgtgaccaaccaagttttaatctgatggacctgcatctgaatcctggctatgttgctcactatttgtcagtttactacacctctctgtgggtcagtttctccaagccttggtttctcctctgtaaaataggggtcataaagtgaccttattgaatgacagtgaggattacatgaagcaatctatttaaatgcttggctgagggtctgttgcatgatcggcatccaattaatggtcatcctcatggtgataaagatgatcagtgtcatcaaatgaaaatgaaagggaatacagcctgagataatagtctggggaagtaagtgcttgtggtagggaaggaagtaataggcaaaaagtatgctttagctctctggatcccagtctgaactctgaagggaggagagaataaatcagtgatcgttaatccgtctcatacccagtgacagagcagtgtggccagagagaatttggggaagaagaacaggaagcacaggaaggcaatgaagacaaggagggatgcttgatattctgaaaggagggttggaggtctgatatgtatttggataatctaaagggagggtttatttatgacaaaggtactttgttagtgggatgatgatttttagtcacattgctgttttgtattattaaatggagagctgttggtatttgagagagatgcccagtttttccagagtctgaaaagagatttttgttgatgttgtagtataaaaagtactctgtgacatggcacatggctgccaaaagtgtgaaagaaacaggaaatcactacacacttgaaatataatagaccttttcattcatcttgtgtttttttccctctgaattgttaaataaaagtatattctgttacatgctacagctagaagcaagctttaagctatcagaatggttgtgaagaactgtagaataatatgaagataactgtatttgtttcatggcataaagttcttttcaaatttggttactcatcctgtggtttaaaagttaaaaagagaccatatatattgtctctgaactctagctgaatctatgtgaaacacaagtagaacttttgggaggctgtgaggtttgtagaagactttaatagaaatgaatgaagagctggcattttgtaataatatttcatcatgtgcttttctttttccgttacccaaggaacatatttgatgtgcttgatatttttgttgttgttgttacctgaaaatcaaagagtacctctttatatgtgtgcctcagcaactttttgtggtttataggataatgtccactctccttaacagctgcacctagagtcctctgccttctgctgctgccagaaggagcagaagcaaactggaagcctcttgcattttcacgtctccttgcctcctcctgtaccagatgaacacctactcatctttctggactgagctcagatgtcaccttctgaagagacccttcctaactactgcttttccctgttccccagtccccattagaagttggcagcccagtccttgcagctccagctgctctgtgcacactgtggcccaacacccatgaggcttcacggggttccctgatggctgtgagtctcttctgtaatctcagcttctgggggataggcatggtgttccattctgcatgctgcttgtcacataataggccctccagaaatactactgaatga

SEQ ID NO: 16390 - DNA, 1277 bp, Homo sapiens
tgttcttgtattcttagggacattttttagctcagagtaacctatgataggaaaagaagataacttctagaagtggtaagttttgtaatatgacagattctcaagcaggatgtcgcttccccattctgtaccatctgacttaagttttgtacgtctggagagcagtggcagtaattgtataattttttggcagctgcacaatgttttgacgacgttgctttagtctccaaagtagacagttcagattttttttttttttcaaaaagaactttctcagaaaggcagtatagtgtatagtgttgagagtacaggcttagaggcccttaacgagatccatgctccatgcttctcgttgtatggtcttggggatattattgtctttctgattctctatttgtaaagtgtaaataacaatacctacctcatagggtcattctgaggattaaataagaccaaacctagaatttagtggacactcaaatatttggtaaatacattttgaaagaatcagactagtagatgagggatagataggagcagggaattcttggagtagattggatcttgttgccatttggttaagtcttctgattttccattgtatttgcacaatatccatgaagccagattttgtgcttttgaaaaacacttggattagaatttggtgtattagtttgctgagctgttgtaacaaagtgcaaccaactggatgatttctacaacagatatttattgtctcactattctggagggtagacctctgaaatcaaggtgttggcagggtgggttctttgtgagggctgtgaaggaaggatctgttccaggcatctccctggcttttatatagccatctatctggagttctgactgtatgtgtgtctgtctctaaatttttcctttttataagaatactagtcgtattggattaggacctaccccaatggccctatcctaacttgattactactgcaaagacccccctctctctagatatggtcactttctgaggcactggaaattatgactttaacatatgaattttgaagggacacaatttaatccataacagaggtatatcagacatgagaatgaaacagacttttacttacaacattttcatttttttaattgtgcgtatttattaaactttgatgtaaattaatggtataatctttttttcttttactgagcccagacattcatttacctaaacttaagtgaagtgtatgtggcacttgaaaaagattggtaaaattgaacaaaaattccttatttcc

SEQ ID NO: 16391 - DNA, 1339 bp, Homo sapiens
cctaaaataatgtttcaggatatgaacagaatattgtctgctgaagacagctacgtatacagatattctagttagcttttaaattttattttttatttacaggctaggtcatagtttttcactttatttttgcccatttacagttaaattaaggatacctaaagatggtctctgggccctgtgttcttactaagattttgctataaatatagaaaagttgaatgaaagtgaaagcaagctgctgagtattttagttatacataaaagacattctgttagctagaaacaatttgcacagccaagtttatttcttcaatttgaaagagtgtatgattcattttggtggtgttaaattcatgaaattagaattaagctatatattttctggagtataaaaagaaaatgccattttaacatttctaaaaagtaaagtatattttgtttattagaactgatattaaaattcttgtgtttttctttatttctcgttcctttttagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgtaagtagttggtgttttcctggttatttgtgattttgctgtattaattctgtgttaacttatttatagaggacaactacttttttacttgcatgagtgagttattaatggaaccagtgtaacattgtgaaagtagtacaggactgagtcatgcatgatgtgtttgaccagtggttcaattacttaattagctttttccctttaagtatgaagtgtaataatgtgttaatatcatgtgcattaacttgaatatctgcttacagaccttgaaatgcctatgtgcagtgaaatatttaaacaaacagtgtctaagcatgatgtatcttgttctactaactttcatggtcagtttttcctggtccctggcttctatttattggctctctttttgccatggctgggctgccttagatcgcattcacatctctgagtgaattcatcttttacatagtgattaatcagagcaagaatattaaatatcttgttggtactttcatgctctcctccaggcaaaatatgttaatgagctttgagtttctccacatagatatggtctctcaagccttgtcaagcctttgtgtttctgactcaatcaccagatgatagatctactatataatattctgtgtaatttctggacatttttgctagtctttcttttgttaaaattcaccttgtccttttctccttctgactgtaata

SEQ ID NO: 16392 - DNA, 1137 bp, Homo sapiens
ccacctcccaggttcaagcaattctcctgcctcaacctcctgagtagctgggattacaggcatgtgccaccacgcccagctaattttgtatttttagtagagacgaggtttcaccatgttggtccggctggtctcgaactcccaacctcaggtgatccgcacacctcggcctcccaaagtgttgggattatgggcatgagccactacacccggccaatatttttcctttttctaaaactccagtcaactcaagtcagtcccggtttgtcactgttataattatataaaaaaagactttgatatatttatcattttatctaccagtccattatacacagtttatattgtacataactaaatgattttgtacaaatgaaattgtaatatcctttaatgttacatgtagcttacagacttgtgagggattgttttaccacatattgaaaactttggctaaaaataattttgtattatatggaaaagtagactttttcagtttctaaaatttgtcttaatactttcataggattttttggaagtaacctaccagattatcagaggtcagaaatcatgatgttcattatggggaaagtacctgtctttggaacatctacccatactttggatatcagtcaactagggtatgttctcagactgtaaatttgaacttaatcttgagttacattttatcctaacgaaatctagaaaatgttaacgttttgtttttttttaaaaatcattagtaatagcattcctatggaaagcagttagtattattatgacagtagattgctaagcaattgaattagcatttttaggcctttagaatcattttcagcttataaattctcagatatttccatctttagaaattgtttggcctggacattgtgtgtgtgcatacacatttagggtaaagcttcaagtttcctgtataaattttaaacattaatgtcaatatatcagaaatattggcttattcctagaattttagaactgaaagtaattttaaagattatgtgacccccttattttatacatttaattggattttataatatgctgaagtttttgtttgtgaatgttgttttgttaatttaataaggaagtaatagtatcttattcgacttacatttc

SEQ ID NO: 16393 - DNA, 1123 bp, Homo sapiens
gaaaacattttttataaagcagacaacatctttgaaatgttgccgttatccaaggacatgaattttaaaagggaggtatctagttgtaaatctaaaatactcaagactatgactacattcttcatttattccttttacatatgttgcatgagcatcaactggtgtgctaaatatccttcaaggccatagggatatagtgtgatgaagcagacaaacatagtccctgtatccacacttcctacactgggggggatagtcattaaataagaatgacatacatgcagttgtttaattagagttgcgtaagtgttatgtaatagaaggacagtatgcaatggccatatatgcatgtccgtgtgtgtgtgtatatatatatgagaacaggaaaggctttcctagggaagagagtttaagttggaaaaattaactctcttgtaaaagaacatttgttttcctttcagaattgttttagaaaataacttctgataaagtggcatttttgttagctttccaaactacctgcagttttccagtgtaatcagagaaaatgctggtgaagtataagaacttgatctctctgatgtgtttgtttcttattaaaggacagtgcaattatcaatgaggataatttgccaatgttccatcgttgtggaatcatggcactggttgcagcatacctcaactttgtaagtcagatgatagctgtccctgcattttgccagcatgttagcaaggtaatgtatttagaaaagtccttaaacttgaattttgtacaaaattgctaattttattccagtgatgattatttttaactttggtgattacgtatcaaattaaggtaattctataaaaatctacagccagtaaactgaaactacagctaaaactgtagctactgtttttatattttcttagatgcatgttgttttattataatagtttaatgtagtggttgaatggaatatgtggttttcttctagaataccttatgtgatttattctatgacttttttcctttgaacccttatgactcttagtatgtaaattttcttaaattatactcttttgttgtttattctaaactacttgaggcagatctcaaaagttgaataattactgtgca

SEQ ID NO: 16394 - DNA, 3074 bp, Homo sapiens
cctcctcccagtccatcaggaacactgaccattacttctgggcatgcccaataccaatctgtcccagtctatgagatgaagtttccagatctgtgtgtgtactgatcggcgcatgaagacctcaggatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctgggactgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtatttttttaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgtaaaaattcactgtgcaattcatatgtcagcaataaaacatagattatttgtatataagttcatttttatagctattgttacatttaattaaatttattcaatatttgcttaaattaaaaatgaattgcttcttttgagcccaatagttcaaggctgcagtgagctaggatcatgccactatactccagtctgggtgacaaagcatgaccccatctcaaaaacaaaaactgaagagctttagtaaaaatcagtatgccaagtgaattcgttcccatgtacattggaagtatcagaatgataactgctagtcatgacaatgacaagacgtagtaaggtaaagtt

SEQ ID NO: 16395 - DNA, 1205 bp, Homo sapiens
attagttcctgcccaatctcccttggccatagggtcgtgatgagctgggactttctctggggctgggaggtctgcagagctgtgtttatcacatctctgcatgcacagtacccacctaatacaggcaggctattccgtgaatattaattaaatgaactgatggtttttctctgggcattttctctcactcagctgtgggactgactccctgggagggagggagggagggtgggaaaaaacagaaggtaagtctggtgaatgtggctgaaattcctgcagccacgggtgtgtgggtgtgaagggtgggagatgggagatggagagggaaatccagacatgtgcaggtggcaaaacagccccaccctttctggaagtgggcagcttgggaagcaggcaaggcaggcttcttagtctcgggggctgttttgcatgataattagcacttcttcatccggcttctgatgaataatttgatccaataaggtcgggaaaatcacttcctatctatgcaggtgaccatatctataaagtagccattgagatgcttgcctctttctcacgtgtaattagtgaggttggaaggggctatgtgctctgtggtagccccacaagaacctacactttggtcttcactggcctgggctcaaaacccatctcttctgatgcccagctgtgtgccgggtgcagacaagtggtttcacttctgtacccttcaattctcatcagtaaacatgaggcttttagtctcttaagaagttcttgaacaaaaatgaggcaatgggctaatattttctcatacccaggccaatgcttagcacacaataggtattcaataaaagccatttttactgtgtttcttctttcattgaataaagcgtatggttgtatatctatacattgtggtaattactattatcatcacaactaataataataccccaggatttgttggccttcatacaatcataggtaggctaagccaaaaaataaatgtaaaaaaaaaaaaaaaaagatgccaagatttcctcaggagcttctagaaagtaaatcaggggtatatattatagccccagtagtaatagcaactagcaaatacttaatttggtgagatatattccatgtctttgtctcctgaacaattagctagatgaataaatagctgtctgccctgagaaagggaacataatatgcaattaaaattaagg

SEQ ID NO: 16396 - DNA, 2388 bp, Homo sapiens
agaggacgggggcccagcagctggatggctgcagggatcaagtcttctctggggctggcacgtaaaagagcatgtggctggtggacgggcatgcctggctcctcacctggcagtctcctgccctctaaccggctgtctcttgttcccctagtgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggcttgtgtcttttttctgtccctgagagattgtgtgtgtgaaacattgcagtgcagggatggctgtttcactggggggttgcccgtccttgacacctaggggaccccagcccctcatctctggaattctttcctcggagcatcacgtccagcagaaatttaagtcagctcatatgttaattctaatttcccagtggccacattttcaaaagtggaaagaaacagatgaaattaattttaataatacatttcatttatctcaagacgtctaaaatattaccacttctata

SEQ ID NO: 16397 - DNA, 1217 bp, Homo sapiens
gattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaaattttgtgtgtgtgagctaacaatttcatgggtttttttttatttaaaaaggccttcataaatagttgtaaacagggaaagaattcatttaacaatgcttgtcataaaagggtcacactaaacattgtacaacttattttaaaaatggtataaaattaaatgtaccattatatactcaccatagatttaaatgctgtttaaagagtccaaatggtatcgagctgcttgagtggcacgttaaactacgcaaaaccaaatcttgtttaaaaactggttttaaaataactactggattttctgaaaaagatgtgatcagttttcatcttgttgagcgttttttcactagtgcaactttggattttttatgagaattttggtaccttaatgaacacctcgctccatgctggaagcactaagcacaaagcttttaaagactttctggcttgactaattgaggtcgcactcgccaaggctgaggatgtgtaacccttaaacggtcttcattttcaaaggtaaataaatcaaataagattttaatctcacttaatttatcttaatataactaataaaaccaggaagattacaacttagcaagtttcattatccattttagaaaagttttaagatcacctaaattctcattttaaaaagtttaatttgttttagtaatctaaaaagccttagtttagtcagtttaattggggccaattactccctattaaacaactgtaaaacctcataactagttatttgtaatacattatttggttagtaattgagggcacttcttaaaactgacaaatatttaataaagtttattctttaatcattaagcttttttaattgtagattgtgtaaaatgtttaatttttatttcttgggggatttttttctgtttatgttgagtaaaaaggtcttttcttttgttaggaaatgtcag

SEQ ID NO: 16398 - DNA, 1524 bp, Homo sapiens
gtgtgttttgagcccaagtgtatcagtgacttgcctccctagagcctctcagttctgaccggggtgaggcccacactcaagtgcagctgtgtcccagcgtcccaggcccatagtgaactctcaacatttaattttgttcatgatgttaccaagggcacattattgtttacttttgttatgctaatttttgtattactttaagtaggtgcacatggttcaaaatcgttttaaaaaatagacattcccatcttcccttttccttctccacctcccagagcacccacttttatttgtttcttatagaaacttacaaaatttatttctgaaataataagtacatgcaaacaccctttttaccgtaatttttttttacacaaaaggtatgtatacattttgcatcttgcttttttcacttactgcatatcttgggaaacttctcatattatttcataggcaatgttctctctcctctttcctgctgcagaatattaccgcaaagcgggagcatgcctgtgtgccccccgcctcgtcaacagggatgcttttccacttccatattgttaccagtctggcagacgggctcttgagcaggtccttttcctctggagatgtcgttttgcaggaaagagcctggcctctggagttaaagtggctccgggggtggccgttctgtccccgagtagcccgggacgtgtggttgagccctccggtttctggttctttccctgagtaagagtggcaactgtcctggccccacctagttgaagggaacaggcacagcccttgtcgtagtgcccaacatggctcaggcatgtcccaacgtgtcttcccttcccccttccactctgggacccagttggacgactctgagatttagaattggccagtgggagcgttttcttcagtgaggattggtcactgctctgagcgtgacttcgtgtgcccatgagccatgagggccgtgagatgacagctgaacgccgaaaccagaaacagtgaaactgagctcatcttgccagcacggcacacacgtttccactctcctctgcctttgattagagtgagtcacagcatggctcacaggggtctggtcaggagtggaggaagtgagatctgatgtcttttttactgaagaggaagttgctctgttctgtgggggctgcaagggaaagagaagcagcagcccccccctccctccgctgcaggcactccagttcccggggtccagtcccctcacactccgcaggggatggcgtttcctaggaggagtggcgcactcagggcaccgcagcagtggggctgagcccaggccactggtgaggtgggggcttggggcaaactgactcagcagagctgacccctcctggaaaggacagcacccccccaggatcacccagtcgtgcgcggtgaccagtggtctcgttgggggttggcattggctctctcctgggcctccccgcaaggagggaaacagctttgcacactgctcggtgagggtcttgttggtgccgggactcgacaggt

SEQ ID NO: 16399 - DNA, 1058 bp, Homo sapiens
cctgaatatgctgcattttctttctttagcttttacatgtagcattttgttttgcttttgttatttttgttttgatatatgctttttggaccccaatagactgttgaaagaaatttaaaaattactcttgtagggatatagtatccttaaaaaataaaaatttaaaaaaatttaaaaaaattgctgcaatatctggctcgaaggttgccctatattagaataatactttagccaaatacacctgaggaggcagacactgtgtttataagcagacaataatgttctgaatccttcctgttcatgctgctttcttaattcatttctccatgtcatcaagaggttggataacttatttctaagctcaaggttaaaaatcatgtcacctttttttttttcccccaacacagacctcagaaaaattgcgattgaggaagtagcatgatcctaaatgtgttgctgaaatcaggcagcccgagcctctggtctctccagagagcccgtcttcacatttctctattcctcagcactcacccgaaactgaacagatggggagtggtcttgattgtcaagataaaactggtgaagaaagctaaatgctgagaaactgagcatctattgtcgtgtttaagcttagctgggtcctttctagtttgtttttacagcttactaggtgaagtagtttgcactatttttgcaataaattcatggaaaacctaacagttacttgttttgtttcttactgtgtgtatataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttacagctgcctcttccaaaaatcttcaattcctcacctacttctttaggcacttccttctgcacaggttatgattccagctcccgaggcagaagcgtgccttcagggatggaagtccagagc

SEQ ID NO: 16400 - DNA, 2473 bp, Homo sapiens
gactcaaatcctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaattctgaggcttcatgtcattgtctttagttgaataccatgctgtgtgtcttgaagatgtccacgcttgcatgatgctaggtggcaatgccactttaaattaagccttaatcagatgttaaatttgtgagtttcagagtatgcaaaaatattaggcagagtgagtgtaaactgttcagatcaagatgctgtatcataattcaagttatttttttctggagttaaagggaagcattcagtgatacacctctctctctctctctctctctccccctctcccccctccccctccctctctctgtctctgtctctgtctctctctctctctcttgtctagcttggctatggccatagcttgatgaaaatggaccattgtgcatttctgtgacagtcaaaaagacctgttctaaaagtcttgcgactttttcagggttttttttttttttcatgtttctttttttttttcccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaaatgtccaagagcaaatttaacattttacaaacaataaagtccaaactcctctatgcacatatttatagcttatcacttcattttctgtgccagtgaaggggtggccagaaaaaaaatcccaagtaccctcatcattgcttttctagccattcatgccccctcttcctctggcacattttctaagagtttatttcataagcagcaaacggactgttgtcgatttcatctctcctgacctacctggtggaggtgctaatggccatggacagaaaggggcgagccagagctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatatagttttactattttaaagagatctctgaattttacaagagaaccaacattccttaatggcagaactttgaaagttgatttgggaggctttttgctgcaggatctcaaaaatagagagagagatgattctacttaaatgtttttaattttctaacttccatcaggttgatacttaagctctattttgtaaagagtaaatc

SEQ ID NO: 16401 - DNA, 1098 bp, Homo sapiens
gaaacttcctcagtgctcatgcgcctcacttgcagaacgtgagtatttcatttatgtttgaagcccttccccaaagtgaccgaggagttgcactctagctgccgtgccagcagtctcgtctgctgtgacgcttctcggtgcggatgcagtgcacctgtgactttgtcatgggggtgcccctgttacacacacacacgctgactcttttttatgaggaaaatcttcgactcaaaataattgcactgattttttgacaacttctttttacgatgtcccacttcgcatctgctgtacttgtttgagatgattgtaaatagatttgtggtaggagaagtgacatgaatgcaacacgtggctctgttgtggagacactgcctcgtattcagtattatgtgttaaagttgtgtggacttaactctgttccgccctttagcttcgtgtctgttgaccatttatgaaggacaagttcgcctcattttctttttcttctgaagggaagttctagatcggttactaggagaacatggtctcttggtgcctgatgatttagtcctaagcagactcgttgcagtcttgtgaacactgttgtggtctgtttgattcctcgtcgcttaccgtggctctccaaagcatggtctttgagttccacccagcctgggacagtccagacgggaggcatctgctccgcctgctactaggacgcaagggcctccttgcatctctgtggtcagagtcatcttaaagccatgaggttactgtcgtgtcaaagctgtcatttgtgcccgttattttgctggagtagcagcgtgtgctgtagcccccgtgtgtcactctgtggtcaggctaccctgtgtcacacccagcaagaagtttttcagccccagaccagtctgtgtgtgtgtccgagtcacaccagtgccattacggtgccctcgcttatgcttctttcagtatgttttgccatgttattgtctaaagtgaatgtattggcttagccaaatcactacagaaggtggttcctaaataccttttagtttaaaaaaaaatgcagataaaggctacctctgaattctcaatagattcatcatgtttgctctt

SEQ ID NO: 16402 - DNA, 1146 bp, Homo sapiens
tggccgcgtcctggcgaccctaccttcaacagagctgccacctatccatccttctggccctgcctccacacctctcacactgcagacaggcgtccccagacgcaatgagctccccgcctcgcagggacacccgacagctctccacagcctgcaaggcaaagccaggccctcgggaagcccccagatggagctctgctctgcaagtcagcggaactcaagcgtctctcccccatctcttggtccccaggcccatacccgcccctcctcccctccctctgtcctgcctcagtgtcatgtgttagggtctcgacagccccgtgtcccatctcctcccctggacccccttccatggtgtgaccagatcagccttggggccgaatgagagccacatcattcttgccattcatcgagcgtggttctgctgcacaaacaggtgaattacagaccccagagaaggggagggaaggttccaagaggcgcccacctgctggaactggccttcagagacaccgtcgcggtagaagatgatgcgggtgggcttgaagcgcgtggacttgtagaactggatgaggagctcgcggaccatggcggccaggtcttgtatgatctcctgccggtgctgctgcacgcgcacggtggcgcagtagcgattggggtgggcgtccatgctgcccaccacctgcaggaacaggcagtgagtgtggtcaggggttcccaaaactttcctttcctgggcatgtgcctggactctcgggaagatggggacgagaagtgtccccaccctggaactcatgtcactgtcaagtgacaatggctggctgggtgtgaactcagcctttaggcttttggtgtctggcaatagtgttcgtaaatacgtactgaagtacaaaagtttgccaagttacatagtttaaacaaaacaaaacaaaacaaaacaaaacaggccgggtgcagtggctcacacctgtaatcccagcactttggaggccgagatgggcggatcacctgaggtcaggagtttgagaccagcctggccaacatggtaaaaccctgtctctactaaaaatataaaaatgagctgggcatggtggtgcgtgcctgtaatcctagctactcgggaggctgaggcaggaaaactgcttgaac

SEQ ID NO: 16403 - DNA, 1265 bp, Homo sapiens
gctaatttttatattattagtagagacagggttttgccatgttggccaggctggtcttgaactcctgacctcagctgatccgcccgccatggcctcccagagtcctgggattacaggtgtgagccaccgcgcccggccagtgtaagtggccttcctaagcagggagccaagtcctttcttttagttgggctctttctctcctgccctggggccctaggtgaggcatttaaatcgttttgttgataaattggagggatgagatagactcactcaacttcccttcctgagggagggaaagcctggcctgggcgaggcgggcacagccgtgctggagtctggactccaaggagcttggcgtccccctcgggaccagggaccctcttctatcaccgacctcggacagagggggacacgcaaagctcagcacagctgccatggctgcacttgccagatgggggcaagagggctggtggcagctgctgctctcggggccagctgaggaaggggcgccggcagagctgtgtgtgcctctcatgtcccttagccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggtgaggcccggcccctttacctccgcctgcggaccagggcacagtgggacgcttggcagggtggggtgcagtatgcagggggcaggggggcagggtcccttcacctgggcccagcaccgtcctggccacagcagagcaaagatgtcagacatagatctggctgctcacgctctgctggggaccaggggcgtctgcaggagtttgagcactgtggccgggtttccagacagagaaatttgtgcctcgaatcccagtgggcaaggcagagcagggcatgccttggatggccaggagatggagatgggcttccctggctcagcagcagcagcagctaccgtgtggaccagggccctctaccatgcttcccacaccaggctagtcatggatgctgcgtcgtgctgggactttagactgaaaagctcctcatgggagcacactgttggcagctcccaggccaggacaggatatgtggccaagcgctggccacctgccggtctcagaggcccagggctgaccgccggggacgggggttgggggtgatggagctgcaccctcctctgg

SEQ ID NO: 16404 - DNA, 1101 bp, Homo sapiens
aactactgggggaaaagatccaaaaggacagtgagctgaaaacctccctcactctgacagtgcctggcctgcacgtggggagagcttcacaagagctccaggcgctgctcagcagctttacggggacagcatcgcatcactgccctggggccgccacagccgcgaggcagcgtgagcgcggtttaaaggctgctgtgttacggtggcaagttagccgcatgtgacttttgagtgcacttacatgttacatgtatgtttagcacacttaacctttctcatgagttagtatgtgttaggagatgtagctctgaattctggcctcattcaggactttaagaacaattttgacctcaatgaaagtgctttgggctttgtaaaaatgacgcccttgtgttagagcctctggtcggcctgagttctctgccattcccagtgcccggtagtgaacggagccttctcctgcaggtccttcacagagcagctcagaaagatctcgagagacgccggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacggtaggtgtgggcgctcccgctggctgtggggagccgtcgtggtctccgtgggtgtttgttcctgcctaagcccctctgtgtttctgctgcactgagaaaggtgctccttttgggcctttcaggaggctgaggaagaagaggtggcttgtcatcactgccacttctgatcactgtgttcagggcctccccgtcgtcctgtatgatgccatggtcctgggcagtcagcaccctcgggtggcacaggccttggcacatgggtgggcaccccgcccatcatacagcatgcgtgttggctggatgggggaacgtttgtttaacgcacagagcgttgcaccagggtcacctcctgcccgggactcagcctatgtgtaaccactctgtgcccacctcagaattttgtggagtttcgccaaagtccatgccagggggtcacccacagggccccacgctg

SEQ ID NO: 16405 - DNA, 1093 bp, Homo sapiens
gacctcaagtgatccttctgcctcagcctcccaaagtgctggggattacaggcatgagccactgtgcccgacccatctcttcctgattctgtcttcattttctccttctaatttacacaaatatggagccaaattattattttttaaaataactgtagttcattgaatccaattctctcttttgcccctacttataaatttccttcagatcctgtttggttttgtctacggtctgcgttacttctccatgctcactgcgagggtgggtcccaggagtgagaggggcaccaatggggccagcatgtcttgccctggcccggccaatggtacgtgacagggaaaggctgatgaaccctgacatcaaaacccataccagcaccctcacccccaccccaaccagagtcagccctgcaagtggtcacttgagctgcccatcgggcagcacccccaggccggagcctctgcctgtggggggcttacttcagatggacttccgtgcactggcgctggggggcgaagcacgcaatggcccacaccttgatctcgatgcccgtgtggaactgcttgttccgcatgtcccagacgccctggacaggggtcgcaatagctttattctgcaaatggcaaaaggttcagggtgagaaaaaaatggaaaacatattccttcaaccttagactttgtcactctcactgttggtccccctgaccaacaactgcttctcagggaaagaacttttgtgttgtctcctgtctctgacctgcctagtgatgcagacaactgacaggatcggtagatggatgggctggtggaagatgggtgggtggatggttgatgggtgggtggatggttgatgggtgggtggatggttgatgggtcggtggatagttgatgggtgggtggatggttgatcggtggataaggtaggtgggtggtccgttgatgatcggtggataagatgggtgggtggatggttgatgggtggataaagtgggtgggtggatggctgatgggtgcataaggtgaatgggtaaatggttgatgggtggataaggtgggtgggtggatggctgatgagtggataaggtaggtagg

SEQ ID NO: 16406 - DNA, 5847 bp, Homo sapiens
caggtagggctgggcagctccagcacctcgtcccacaggtagacgtctttcgcacctgcagctgctttcacgcccgcagccaccgaagactggagagagcccagaagtgccggtgtcaggacacagccccgctcacctggtgggctgggcacagaggccgtggggtctctgtgttcgcgtgacgtggggtttacttaacaggcatttctgttgtgaagcggaaggccgtggagcagcccccacagcagacacctgcacagcacttcatagcccagggatgaggcagagacggtcccaagcagagccaggccaccagcccctgagccccctgcctgctcccctggtcactccagtgcggcactgacggcctgtctctacgtcctcttcacaggtctgtaacattgtggcaggacaaagatgtattaaaaaattaacggacaatcagacctcaaccatgatcagagcgactgctaggtcggcgcccgatcggcaagaagagattagcaaattggtgagtgtcagtcccgggcagggctgccctgtggaatccagtccggttgccctggcacagaaacctctgatgcttggaacggacgcagctgctagagagatgggaggcctccacccactccgtgcgttttcttgtttccctttgccagatgcgaagtgcaagtttcaacacagatccatacgtccgtgaatttggaatcatggtcaaagatgagatgacagacgtgactgggcgggtgctgcagccgccctccatcctctacgggggcagggtacgtgtggggcggcggggaacgtgtggctgcggggcatgtctctgccctgcgacccctctcaggttctgagctatcgcccgcggtgtagactgtgttccatgcaggagaatcctttctactcccggctgagcctgtaaaagacgtgagatttcataaaggaatggctttccttggtcctttttaaagtttttcagaattatccttaatgttttcagaagataatttttattatcccatgaaagtttagagagcaccattctgtgtgtgacagacactcaccgagggtcgaattatttcccagaaggctgtactgcttttctattctttaacttttgctttggggatgtttggtaacagttttttgtccttgctaatttaacttctggttttgtttgttttgaggcagggtcttgctctgtcacccgagctagaaggcagtggcatgacctgactataggtcactgcagcctctaactcccgggctcaaacaaatctctcgcctcagcctcccaagtagctgggaatacaggtgtgagccactgtgtccagcccttaacttctcctttttatcagtgtgtaaccaaaggtgtcctgaacactgagccctccagggtctcctctcatttcctcctgggctcgcttgcataccacggttgcaagcataccatgtctgatgggagggcccagaggtgaccatgctggaagggacaccagggctctgcagggtcttagtgtcagaggtcactgactttcttaagcacctggcatctgtgtaagagtctgcctaaccttttacaccctagtttctacctaatggaattttattctcatcctcaagacctgtagcgaggttttggtttgttttttgtttgtttgtttgtttttcttgtcttattttaaaatatgggttctgagctgggcgcagtgagtggttcacatctgtaatcccagcacttcgggaggctgagacgggtggatcgcttgaggtcaggagtttgagaccagaaaccctgtctctactaaaaatacaaaaattagcctggagtggtggtgcgcacctgtagtcccggcttctcaggaggatgaggcaggagaatcccttgaacccgggaggtggaggttgcagtgagctgagatcacaccactgcactcaagcctgggcgaaagagcaagacttgtctcaaaaaataaaaaatacttaaaaaaaacagttctgttttttaaatgtttcagaattcagaagatacaaaagaattaaaggaaaaagtatcttttttcccagttctcagttgccctctcaagaagcagttggtgttccttctcctttgtaaaatcacccagggatgattcacccctttttgtgaaaataatagcattacctatatttctgtgcctcgctgttttctagctaacatttccttagagctcactgagaggctgctggccgttctgtgttgctgttcgtgtgtgtcttgtcctctagcactgctgcgtggcaccccatcacgtgggggggtctgtgtccctggtggtgggcatggccactgcttgtctctctgaagggagtctgagcagggcccttcagcccctccttggctcgcttgtcccccgaggccccagatgctgtataaacacagcccaagcccaggaggaagagcccgtgatcccccttcatgagttggggaggagacgccccgggagggcaagaggagtgcctggcccctgtgcggggatggggcttttgaacccagcaccgcttcacagccctgctggcttctgttccctcgggcttcagctgttagcaagggcagtggttgtctgaaaaacagaagagcttgtgtaagccaacgttgcaaaaatctcaagagtgtagggattaagagagcttgtaggctgggtgctgcggctcatgcctgtaatcccagcactttgggaggccaaggcaggaggatcacctgaggtcaggagttcgagaccagcctccggtcaacatggcgaaaccctatctctactaaaaaatacaaaaattagctgggcatggtggcatgcgcctgtaatcccagctactcgggagactgaggcaggagaaccacttgaacctgggaggcagaggttgcagtgagccgagattgtgccactttactccagcctgggcaacagagtgagacactgtctcaaaaaaaaggccaggcatggtggctcacacttgtaatcccagcactttgggaggctgaggcaggcagatcacctgaggtcaggaattcgagaccagcctgaccaacatggagaaatcccgtctctactaaaaatacaaaattagctgggtgtggtggcctatgcctgtaatcccagctactcgggaggctgagtcaggagaatcgcttgaacccaggaggcagaggttgcggtgagccaagatcgtgccattgcactccagcctgggcaacaagagcgaaactccgtctcaaaaaaaaaaaaaaacaaaaaacaaaaaacttgtaacttgtttgaggcagagtgtttctctgttgccctggctccagtgcagtgacgcggtcatagctcactacagccctgaccttccgggctcaagcgttcctcccacctcagcctctcgaattgctgggaccacagccacaccaccacacccagctaggtttttaatgttttgtagagacgaggtctcactatgttacccaggctcatcttgaactcctgggctcaagcagtcctcccacctcagctgggattacaggtgtaagccactgcacctgactgagcgtgtaatgcttctgttaatacatgaatacatttttccagatctctaaaacattataatgtgaggaaacattcctgtcccctactctacctacccctggtccattgttagtgcaaaaaaacaaaatatccctcagaaagcaatgtgtacagcaggagttctcgaccagggatgattttgccccccaggggacatctggcagtgtctggagacattttttattgtcacaacttgggggtgagtgggatcgcctacagggcacaggacagccccgtaacaaagaatcattgagcttcggatgtcagttgtgccgaggttgagaagcacctgtatagtaagagtgtgtgtgtgtgtgtgtgtgtgtgtgtgtgtgcgcgcgcgcgcgtgcatgtgcgtgtgttcatgtgcatgtgagtgcatgcgtgtgtgtgtgtgtgtgcactccctgtctggagccccaggctgtctgtgagactcttgcacacagggaggctggtgggaacaggcagtagttataaaaatataggaaacaaagcatttgtttctatcacgtgtctgatttctacagcaggcttgtattttgtacgaaagatgcttcctgctaaaaaaaacaaaaacctctccagagtaaatgacggcagcccaggcacagccgcatcctttagcaatgcccccaggcctaggagtgcctgtccctcccacacgggacccttcctggcccacccttcccttgagaatcacttgaagccagttcagagattccttaggtgacagtgctcagggctggctgagagctggctgagagctgacagcgcatttgcacagcccgcctttctcttctcaagtggaagtagctcccgtttccgacacagctgcaggcagtggcatgctgagtggaaaaagctatgggctcagtcccagctctgatctccccttcccacatcattggtgatagaggaggggaaatgagggaaagctctgtatagaacaggaggccttcctgtagcatggcaaggcctgtagcatggcaaggcacttctcttcctccaggctgctcatgaggttggatggagctttgggcctccctcctcctggcttagctcccatctgtctgttcattacttacccatccatcctccatctaactccatccatccatccattcatccattcatccatctctccatctctccatccacctacctaccttatccactcatcagccatccacccacccaccttatccacccatcaaccatttacccattcaccttatgcacccatcagccatccacccacccactttatccacccatcaaccatccacccacccatcttatccaccgatcatcaacggaccacccacctaccttatccaccgatcaaccatccacccacccatcaactatccaccgacccatcaaccatccacccacccatcaaccatccacccacccatcaaccatccacccacccatcttccaccagcccatccatctaccgatcctgtcagttgtctgcatcactaggcaggtcagagacaggagacaacacaaaagttctttccctgagaagcagttgttggtcagggggaccaacagtgagagtgacaaagtctaaggttgaaggaatatgttttccatttttttctcaccctgaaccttttgccatttgcagaataaagctattgcgacccctgtccagggcgtctgggacatgcggaacaagcagttccacacgggcatcgagatcaaggtgtgggccattgcgtgcttcgccccccagcgccagtgcacggaagtccatctgaagtaagccccccacaggcagaggctccggcctgggggtgctgcccgatgggcagctcaagtgaccacttgcagggctgactctggttggggtgggggtgagggtgctggtatgggttttgatgtcagggttcatcagcctttccctgtcacgtaccattggccgggccagggcaagacatgctggccccattggtgcccctctcactcctgggacccaccctcgcagtgagcatggagaagtaacgcagaccgtagacaaaaccaaacaggatctgaaggaaatttataagtaggggcaaaagagagaattggattcaatgaactacagttattttaaaaaataataatttggctccatatttgtgtaaattagaaggagaaaatgaagacagaatcaggaagagatgggtcgggcacagtggctcatgcctgtaatccccagcactttgggaggctgaggcagaaggatcac

SEQ ID NO: 16407 - DNA, 4564 bp, Homo sapiens
tagtcaggtcatgccactgccttctagctcgggtgacagagcaagaccctgcctcaaaacaaacaaaaccagaagttaaattagcaaggacaaaaaactgttaccaaacatccccaaagcaaaagttaaagaatagaaaagcagtacagccttctgggaaataattcgaccctcggtgagtgtctgtcacacacagaatggtgctctctaaactttcatgggataataaaaattatcttctgaaaacattaaggataattctgaaaaactttaaaaaggaccaaggaaagccattcctttatgaaatctcacgtcttttacaggctcagccgggagtagaaaggattctcctgcatggaacacagtctacaccgcgggcgatagctcagaacctgagaggggtcgcagggcagagacatgccccgcagccacacgttccccgccgccccacacgtaccctgcccccgtagaggatggagggcggctgcagcacccgcccagtcacgtctgtcatctcatctttgaccatgattccaaattcacggacgtatggatctgtgttgaaacttgcacttcgcatctggcaaagggaaacaagaaaacgcacggagtgggtggaggcctcccatctctctagcagctgcgtccgttccaagcatcagaggtttctgtgccagggcaaccggactggattccacagggcagccctgcccgggactgacactcaccaatttgctaatctcttcttgccgatcgggcgccgacctagcagtcgctctgatcatggttgaggtctgattgtccgttaattttttaatacatctttgtcctgccacaatgttacagacctgtgaagaggacgtagagacaggccgtcagtgccgcactggagtgaccaggggagcaggcagggggctcaggggctggtggcctggctctgcttgggaccgtctctgcctcatccctgggctatgaagtgctgtgcaggtgtctgctgtgggggctgctccacggccttccgcttcacaacagaaatgcctgttaagtaaaccccacgtcacgcgaacacagagaccccacggcctctgtgcccagcccaccaggtgagcggggctgtgtcctgacaccggcacttctgggctctctccagtcttcggtggctgcgggcgtgaaagcagctgcaggtgcgaaagacgtctacctgtgggacgaggtgctggagctgcccagccctacctgaatgacaggatctaaacaccaagggaagagttacagcacatggctcagggtcggaatttgatcctttcccaaggcaaggatttttcaaagagtcgtgatgttagaggagagtgaatgacgcaacggtgcagtgacggagcacctgcctcgcgctgcggggcctgctggacacgttacacacaacctcaggcaaggttcacaccaatcccacaagagagctgcagaccccattctactgaaggcaaaaccgaggtgtaacaaagcccattaacccacccgcattcctgcagcagcagaggcagtgccatttgtatctgactggggcctcggcggtttctcgaagctgcatgccccagcctgggacgccgccctcccaagcccccagagacacacaggaagagggtgacttgcctccaggggaaggtaggtgtgtttctgctcctgtccgacttgtaaacatgggaggtgggggtagcgcagaaccaacttgtgcctgtccttgaaatactgggccaccgtgcactccaccgtctgcccgctctcctgctgcagcgggaatctgaggagcaaaggggctgttcaggccgagggcatcccggagccccttcccctgcgctgcttttcatttgcgtttgctttttagggtgacgtgtgaggagcaaacattcagagcacttccgggagtgaaaaccatgtcatgtgctttgggttatctggaatgtttctgagcccctaaattctcattttgtttctggagttgggaaacaaaaaatacctacatgcatcattactcataaattatccacaacgtcacagtgtgtgtaaaggagtcaggacgaatgggcacgaccagaaaggcctgcgcgtcttccagcagaccgtggtgaccctggaagccttttacgtgccgcgcgctcccggtgcccagaaggcctgaagcccccaggacaggacgaggaaagcaggccaggccggttccggccgcacggtgacggcaggagacgcctgggtgcagtatgggtgagtgagggggaggcccacaggcacaggaagggttggcctctgtgtggggatgagggcacgggggctgctagtgcagggcaaagggccacgtggctcagtttctactgcacagaccccttcccccaatccagactgccgggccatctgcagcctctgccaggccacaggccctctcgtccttctgctccctcagccacgggcatcttggtacctccagtgcctggcaacaggcctggcactttccatggaatgatccatgaaataaacgaaccctaccggcctgggagacattaactggggcacaggggccaaatctatcacctcctcccgcaaagaaacaccagtacaacccaggacagcggtgcactctcaccccccactccggcctgcgtaccaaaccgtgctcttgccgtaatgatgggacacgcggactggcccagggaagggggcgtgggtcagggccacagacccgccacctccagcactaaggatgggacaatgaacacaaaagacccttctctcctctgtgaggctcaggaaggaagagggagagagagcctgggccggcccttctagcacccagggggaatttcatgatctgagtttattttcttaggtgaagtctggaatctactgagccatgtaagggacaattttgggattgaaaaacagcatgaaatggtcctttctggagaatgggcacagaatcatggctccagagtgtgcccgtcggagtgacagtgggggccccagccaagagagtctgaaaggaagggcgtgttacgtttggtgactggcgggccgccgggtcacattgcagacgcggtacttcctcttcatctgcccacagtgcgttatctccacctttagacctggggacacagaacacaggcatcggcatcggggctgtcccgacctgagtgcaggcgccacttgcgagaatcagttttcataggaatgtggctggggacccaagttatggggggctgcagggctcccctagggagggtgacccacaggtcacccccaggccaccccagccgggtccgtctcacctacaagagtaccacgtggtggaggggaggctcagcttagagcatggggtgtccaccctcgtgctgttctgcgccccccatgggtcatcgtgataacacggggtacggtggatggccctgcaaatggccttccaaaaggacgggttcagcgggcagggcttgtggagccaggggtgggccccccattctgttgctgatgggcagaaggaccccgggtaagtcctagaccccccccaatctgagtttcttggagtagaaagcaggctgactgggtacagacacctgccgggctgtgtaaggattaaatgaagacaaaagaaaacgcatcctaggttccagcgttaggaaatgctgatcacagccacgctgctgcttctagtcctgagatcatgactcagacgtgactgactccccaacctcatcctcaccccatggggttgtatttatttaggaaacccccactcccgctctgggaaatggatctaactcatctccatgctacctcatctgatggctacattctgccacccccacctccccaaatgcgcacaagaaccagaactgcaaaatgcggtcccggaggcggaccgggaaggggcctcccagccctcagccaggtgtgctgggacagttcattacctttaatttctttggtaaactttaccctttgggaatctgtcagaggtttttgttgttcttcaatacttttaaaatccaaaacttcacaaacaaactcgattactggctgtgccttgtaaaacgctgttgctgacactgtaggcgagaaaagaggcaaaggcctaagcatgactgtggggctgctggacgggcccatagtcctggaggggcctcataggccaggccagccatggtggggacacccggccggggttctcactccctactgaggctagcctcaggcccagacacgggcaggccagcagtgacaagcccaggccctagctgctggcctccctctggtcagggtgacagaaaggagctggctgattagttaaagactaaagtcaccctccgagaatgaagccagtgttgtaggattttctggttaccgtctggtgtagatatttctgaaattcaccatttccttttatgtagttctttttcaataaatgtataactgagcaagatcaaattctcattgctttctagagcttttcataataatcagctcccaaatgagaagacagatccttttcgctggccttcactctcgtctttttcacaga

SEQ ID NO: 16408 - DNA, 1100 bp, Homo sapiens
ctccccacggctggggctgggcctggctggggctggcacttggcaggtgcccaattctatctgcgcttggggacacaggccccaagaggtgaagagtagacagtgaggacagtaaggcgaggcaaagccaggacagggagtctggaccagaaacacgccaggtcctgggggcttgtgatccacctgtgcggtgtctttaaacgtctttcaccatcccccagtgaggccacgggtcccccagcctgctgctgtcacagtgtcccacacagcaggccatgcacacaggctggagtgccgtgtggtaaacgtggatttaaaaggaggggaaacggaactctgatgagggtgtggtgggcgcaggcgaagcccacccagaggcagctgttccttccggaagacacatctgacgggaggcggggtggggtctcttggttccaggtacacccccgtgggccgctccttcttcaccgcgtccgaaggctgctctaaccctcttggcgggggccgagaagtgtggtttggcttccatcagtccgtccggccttctctctggaaaatgatgctgaatattgatggtaagcagcgccctggggtcttcactgcagggcagggttgggcatgggctggggggtcaggaccccggtcggggggtggcatgtggccagctccacgcatggcctctgtcagagccagcgccgctgcgtgacacctggctggtctcacctgcagtgttgggtgggttacggcagtggctctcaggccagcgtgaagccacgagatggtcgcaccctcagaggctgtggtcaggggctgaggcgggcctgaggatccggggcttccttgctgctggcctcctgtaggcctgggtttgactgtagcctgggtgtggcctgtccctctcttgggaggcttagtcgctgctctgtgcaggacatccgctgccctctctgtgaaaaagacgagagtgaaggccagcgaaaaggatctgtcttctcatttgggagctgattattatgaaaagctctagaaagcaatgagaatttgatcttgctcagttatacatttattgaaaaagaactacataaaaggaaatggtgaat

SEQ ID NO: 16409 - DNA, 1189 bp, Homo sapiens
aaatggagaagggttgtcttttttttaaacagacatttgagtgaaaattgaaagcgttctattattgaaaaatgtttatttttctaaatctacattttgaactttactaatatggagccactgaaaacttgagttgggatgaagtttctgccgcttatgcatagtaaaaagcgcttcctgagtaaacgagcggtttaagcagcagcaagggaggggcaccgccttgacacttttgggctctttgccttgtctcccgtgctagtaattcatgctgcctcatctctccagtgtctgagacaggaagaaagaacaggaatggacatagcaagtttgatcaccaatgagttgttatgatacattttaagtacattattggcttgacgttgagacgcctcctctgtggaatgcaatattggcctggacgtgaatggaaacagcagaggggggcatatagtggcttggggccgcgggatgggaagggccgcagagcaagcctgctcccccgttaatgggtgttctctctgccattccagcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacaggtattacgtttcatccttcatgacctgtgtaagtggtctgcgcggacagacacggcatttaaactaatcaactctgaaattctcagcagatccatctgggttttttccagaacgtttcagctgcatttgcttttcaaaaacagtttttcagagtcaaacctacggattgaaaaaaatatatatataaatatataccaagtttttgtattgagacacagtttcaggatagtgaaatacatacatcgtaaatgcacaactggaagaatttcgacaaatgtatatactgatcaccctagaaagttgcctcataccctcttccggttacccccagcccctaaagtcacggcattctgatgtgtgtcacatagattagtttccaggtctgtatagtgacacaccctcaatcccgactgcttttactcagcagaatttatgagacccacctgcgccgttgtgtgtattt

SEQ ID NO: 16410 - DNA, 1371 bp, Homo sapiens
ctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatcctttcttttggttctgtttcttcagatggcttttcaggtgacttgtcagataagataacatacaagagagttcccaataattatcaggaagcctctcactaattagtttctttttttttatttaatcttctaaacaagtcaaggatgttaccacagaagggtagcgtggcgtaagttaaccttttcattccatcgtca

SEQ ID NO: 16411 - DNA, 1824 bp, Homo sapiens
agattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccaacgtgtcagaggaggccaaggaggagcagaaaggcctgtcttccccgttggccggcgaaggcagggccggtgggaacagcgaaaagcccaccgtgctgaagctcacgcggaaggagggcctgcagggaccggtggagacagagtccgtggtctgagccgcactcccgtttacacacattccagtgggcgggtgggcgggcgggcgggcggcggggccaggccatgggcgggagcagagacaccgcggaaccctgcagatgctgtggccgacccggcagtgcgggccagagcccctccgcccccatagccacaattcagtagtcgtagggtaggtttgagctactaagcaaataccacactaaccactttttcgataattaaaagaatcatttgaaatattttttttaattgaaaaagatattttaatttcagctcttttattctgcaggtgtattattctgcatgtttttaaatgatataaaacatttatatagacaataagcaacttagaaaaaataagattttgcatttctaaaattataattgaaaacaaaatctgacattctctgctaagtcttatctgaatgcttcagataatggtagtgtagtcagtgactaaaatatttttatcaaatttcctctctgtagacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccccgctcgtcccgtctgaaggactctcctaggaggccaggttgcccctccagaccgctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctag

SEQ ID NO: 16412 - DNA, 1098 bp, Homo sapiens
tcaaggggcagttctgtcgggtcagaattctcagacccagcagcagctgcagtttcttgttttgttttcctactgctttctccttctccagcccctgactcccatcatgagggcagccccggccccctgttagagggagaggccctcccagagcttccccccctgtggcctggtgccaccggctcaccggctgctgcttcctcccacgcaggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcattgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctc

SEQ ID NO: 16413 - DNA, 1207 bp, Homo sapiens
tttcgtatgagaaaatgtttttctagaaagtaggtttggttatttgcacagacgtacccagagtgagtggcagagagctgtgtgatcttgggtcgggccctcggggcacacggcttgctcgggggtcgggcggcggtccacagggccatctggtggccgtcccctgactctctggccgggttgttttcctcttttgcagatcatccagtcactcgatggggattaccagcggaccacctgtttgtatcaccttcccacctctctgtagcaagaaaaatcacttcagcacctcttcagtaataatgatgaaactggtattaactgaatggcaattatggatttttaactctaattcacagtaaaccagcaagccatatgtttaaaatccaaccaaaaatcgttctgtgttgctgcatgtctcataccgttgtgagaagttgtgagatagccacttgtgcaaagaggaatgtaagtgttacctgcccgaggaacacagcagaagcagaaagagaagacgtcttaatttatcattacagatatatgaaagcattatttatatagatagaatatatagataaatacatatatttttggtggtaatgaaaatggctccgcagaatgccgacccggaatctatgcaagttcaagagttatccgtgcccctgccggacccgcagaaagccggaggcgcagaggccgagaactgcgagaccatcagcgaggggtccatagaccgaatccccatgcgcctgtgggtgatgcacggggcggtgatgtttggcagggagttctgttacgccatggaaaccgctctggtcacaccaatactgttgcagattggtaagtctcctccccgtctgtgcgcagtgaacgctgagcggagtgctagcggactgggcgtggctctgatcctctggaggcagaggatggtgcgtcctggagagccccgggcactggagtctttgtctcctctcccttcagcctgccctgatggtggttttcgtctcctgttttcagccaggtttggggaggagtgatcttcggatgttgacgttgaattacagttttggcaaagtggtagctcagcatctggggcagaattggcactgataagtactggctctcggccggggctcacctctcccgctgtccctgccaggccacagtgaacaacgaggcaaagggcagggtcgccagcactgacagt

SEQ ID NO: 16414 - DNA, 1202 bp, Homo sapiens
aataggtgttgtgtttttaaaggattgttaaaaaaaaaaaaaaaaaaaaaaggaagaagaaacaaaaaaggagaatgtacaacagagaccatctgtggcccgaaatcccggaaatgttcatcatccagctttacagagaaagcttcagtgtctggtcttgtcggtggactcggaatggaataatcaaggggtgaagcatttttaaagaaagccgttttcctatttagtaataaccctagaacagagtgtctccctctggtgctgttgacgttctgggccagggccttctctgctggaggctgttctgtgcactgtggtgagttgaaaggcatccctggcctccgcctataagatgccagtactgtcccctcctccccctgttgtcgcaagcagagatgtctcacgtcattgccaagtgtccctggagggtgcagagttgcccctggctgagaatcactaccttagaataattcatatattacttattacagacatttattgcctaactctcagctcttactggaacgactcttaggaacagagacggcttcacttcaggcacaagtctccgaggacactgtaatgggacaaagagccgattgagcaggcatgaagggtctgatgtttataattaagtcattaggatttcttagaaaactaattgcttttgttcctgcccaaaacccagctgatgttttcagtctttgcagacatgtctgggtgttacttcttctcacaaaaatgactcttcttacctggtggaagaaagcagttaaaatcattgaccctattctggtacaagattgacagactgaaaacagggaaaatcgtgaaattttctgttaggaatgattccgaaaaggtgggggcggaacaagaatagcagaatgttggtccttattaaacctgggtggtttcttacactattctgtttactttgcatatgttagaaatagttctggctgggtgtggtgccccacgcttgtaatcccagcactttgggaggccgaagcaggtggatcatgaggtcaggagatcaagaccatcctggccaacatggtgaaaccctgtgtctactaaaaatacaaaagttagctgggcgtggtggcatgtgcctgtaatcccagctactcaggaggctgaggcgggagaatcgcttgaagctgggaggcggaggttgcagtgagccgagatcacaccac

SEQ ID NO: 16415 - DNA, 1360 bp, Homo sapiens
gtgcctgggcccatgcctcgctgccctgtggccgccgctgctgccgctggttcttgctttagaactgctgtcttggcagctttcacttctcatgtaggcgagtcccaagctaatatttatcctccaaagtatcttaacaatgctagattgctgagtgtttggggggaactttattaatctttgaaagagttattgttacattgataaactgaggcactgtttacaatagccagattgtgtttggacttgcagcctttaattctgccgttagtttttgttcgcagatggaattgttttggctgttcttgtaaagactcctttgtccgtgtgggttttgtttgttgccggccagcgcggggcgtgtgccagggagggcagcctggccagggaggggtgcgcgatgcaccaggtcaggtgtttccactgcatgattggcaggcttctcgggaatgcggaattgtgtactcgaagcccccaactttttatgaattgtcggtttacaactgaaggcatctccttccagagggaaagctggcctccctcatcaaagacttgcaacgtatgtgaaagagcaagtgacagacgtaagaatgggggtagagggcattgagatgtggtccgtgggattgcaggtgtaaaggaaaatgacactcttagccgacttgctccttcaaacaaagtcagctatgagtctgtcctgcggatgttacttttcagtaaagccagacttgtcctggctcccctccagagccgtttccttcacctggcagccatcctgggcttctgagtaggcggatgggaggcaaggaaaggccgcctggcacggtggggatagagccagggccccgaggccacaggggctcccacgagcatcggcccttcctttccaggctgcgtgggggaaggaggtgagaggagaaccagcagagcctggaggtgggtcccgcagaatgtgggagccgtcacagaggtgggggtcttggggtgaaggctggagctggaaggtgtggaagccaggcccagccaagcctgtggagagaaactgtgcccacaggctgggggccaaggtgggggctggggctttgcttgtctggccttgaaggggacagagcaggctgaggtgtgctgccctggaggctggagccctggcccccagcagcctggcagtgaaatgtgcctgggggcagtagggacagagcccggggcaaaggatgcccccagcaggtctgagcagcccttgctgcatcctgcagtgctgcccactcccttgcgggtgcgtctgtgccttgttgagacgttagcaaggagcccagcttcctctctggtcagctgattgcattgcatttttctgctcactcac

SEQ ID NO: 16416 - DNA, 1130 bp, Homo sapiens
tgtgactgtgggctcatgacaggcatgaaccccttgtgggaggcggggccccctgtgatccctttctattcatttccttcgtctttccccacagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggtgagtggagacggaggtgtggcaggcaggtggcccaggtgtctgggaagcccggctgagctgccctcaggcctcgca

SEQ ID NO: 16417 - DNA, 1115 bp, Homo sapiens
attgccccttaacattttaaagccttgtgatgctgttatctaattgggtactcgtcaaggcctagtaaggatatgggatatgtagttctaccctacaagggaaggatagtgtctcagtccatgttggctgctgtaacaacctgccacagactgggtggctgtcaaaaacagaaatttacttctcacagctctcgaggctctgagaaatccaagattgaggcgccatcagggtaggactctggggagggccctcctctgggttgcagatgaccgttttcttattgtgtcctccatggtggaagtggcaagggacccctgcatggaatttttgggaagggtcctaatcccattcgtgagggcttcaccctcatgatctaatcaccccccaaaggcctcacctcctaatatcatcaaatcaggggttaggatttcaatgtatacattttagaaagacacaaacattcagtctgtaacagagcgagaggagacgggaagggagctagatttggaatcccaacatctgggttgagtcccaccacctccacaggaatgtgaccttgagtgtcataaaggttaaatggtgcaatcatgtcttaaggtgaatgagcaggaggaggagggttagaagcctttgtttccaatcccacatcctccccaatttcccacgccacattgactgctccatcacgggctgtagaatctaagcattgcagacgacaaacctgcatatctggaagcatcttcatcatctttaaaaaataaccctcatgggccaagcacggtggctcatacctgtaatcccagcactttcggaggccaaggtgagcagatcacctgaggtcaggagtttgagactaacctgaccaacatggtaaaacctgatctctactaaatacaaaacaattagccagtcatggtgacaggtgcctgtaatcccagctacttgggaggctgaggcaggagaattacttgaacctgggaggcagaggttgtggtgagccaagattgcacccatttcactccagcatgggcaacaagagttaaactctgtctcaaaaacaaaaacaaaaaataaccctcatggccagctctgtgcgaaggcgaggcaactggct

SEQ ID NO: 16418 - DNA, 1507 bp, Homo sapiens
cctgcagagggtcctaggcatgggagatcctgggtggctgcctggacatgttccacagaggtgaaggcacccgccctctctgtcttccgcagacccgggagcacctggccaaggctcagcgagggctgcctggggagggggtctcggaggtcatccagacactggtggagatctctcaggacgggaccagctacagtggggacctgctgtccaccatcgatgtcctgaggaacatgacagagattttccggagagcgtactacagccccacccctggggacgtacaggtgggctccccgagcggcattttggaagagggtgtcgggaaggtgtctggggagccctcctcgaccttagagatggatccccaaccctggccacagcccaggccctaacccatgtcataggttgaactctgacctttgtcacacatttaatcttggtcacacattgagccctgaccctggtcacacactgagccctgatcataggctgagccctgaccctggtcacatgctgagctctggtcataagctgagccctgatcctggtcacacactgagctctggtcacacactgagccctgaccctggtcacacactgagccctgatcataggctgagccctgaccctggtcacatgctgagccccaaccctggtcacacaccatgtcctgatcctggtcacactctgagtcctgacccttgtcacaaactgagccctgatcctgatcatacactgagccctgaccctggtcacactgagccctgatcctggtcacacactgagccctgatcctggtcacacactgagccctgaccctggtcacactgagccttgatcctgatcacacactgagccctgatcctggtcacactgagccctgatcctggtcacattctgagccctgatcctggtcacacactgagccctgaccctggtcacactgagccctgattctggttacactcagaaccctgacactggtcacccactgaaccctgaccttggtcacctgctgaaccctgaccttggtcacatgctgaaccctgatcctggtcacacgctgagccctgaccctggtcacactgagccctgatcctggtcacacactgagccctgatcctggtcatgctgagccctgatcctggtcacacactgagccctgaccctcgtcacatgctgaaccctgaccctcgtcacatgctgagtcctgatcctggtcacacgctgagcctcgatcctggtcacacagtgaaccctggccctggtcacacactgagccctgatcataggctgagccctgaccctggtcacacgctgagctctggtcataagctgagccctgatcctggtcacacgctgagctctggtcacacgctgagccctgaccctggtcacatgctgagccctaatcctggtcacgcactgagccccaaccctggtcacacaccatgtcctgatcctggtcacactctgagtcctgacccttgtcacaaactgagcc

SEQ ID NO: 16419 - DNA, 1095 bp, Homo sapiens
gagggaacggtccttattgggtttcaggtttccatgggcaccacaggtggtgtccagagatctggagaatgtggggctgcttactgggaggggggtggggagggggcaggacagatgtgtgagcataggaccaggtgctgaggccacggggcctgagccccagcattcaagcatcgcgtcaggaaggagggtcggccagagaccccaagagaagagccaggaagggcccaggcctggggaaggagggacagtcaggtggccttggccctgccagcctggtgcccctgctgtgtggctctaagcaggtgggtccccccctctggtactgtccccatctgtaaaatgggggtgacagtggctgcctggggtctcctgaggattctaaggctaaagagtgggtgtgacctgccctgcatgccgaaggcgcttaataagtgccagttttcttctgccacttcccagctcacccctactcctgagaggccggcagcacctctctgcacgcccctctgcacacgggcggtgctgatggcctgtctcctccccagctgctggctctccctggaggggggactgctctatgccttcgtgggacctgccgctgccgttgtgctggtactgacccgcccaggccccactccccacgaccccacctgggccccccacctgcctcctgggcctcggtgctgtctcatgccccaggctgtgcacctgctgtcccttcaggatggccctcatggccctcatcaccagggggtgggggtgcccacagccccactctgacctgcccttggcatgcagtgcaggggctgggccagggtagtgacccttcacacctgtgagtctcggcttgcctgattattgggtgccagctgtgtacctgccaggagatccccgcgggtgtggtgagtgagtggcatgggaggaagctggggatggacggatgatgcgagcagcggggagctgcaggctggacctgggttgtgggtgtctggccccagagcgccagatgtgaggctggtgaccgcggctgcttgccccttcgggggccccggtgaggaccttccctgtgtgggtccttgggctttccttccc

SEQ ID NO: 16420 - DNA, 1144 bp, Homo sapiens
actaaagattaaaaattaaaattcgtttttgcaataatgacaaatgtcctgcacctacccacatgcactcgtgtgagacaaggtccataggtatggccccctcttccccctcccagtactagttaattttgagtaattgcgtattgtcagaaaagtgattagtacaagtttttgttttgttgcttcaaaatttttttgtttaaaagcaaggcatgcttgtggatgactctgtaacagactaattggaattgttgaagctgctccctggttccactctggagagtaatctgggagatcttagtgtgtgtgtgtgtgtgtgtgtgtgtgtgtgtctcctctttctttgggaggagtgtgtgtggggtttattttttagtccttttttttttttaattcattaaccagtggatagcccttaggggaggaggacggattgattccacattccacttcctagatatggtttagaaaacatgttccccacctggggctctcaggaaggagtatagtaaatgcctcatttaataacagactcctttttgaaagttgccttttctctccacctttgagtagatccagtatttgatgaaactcatgaaagtgggtggagcctgtcttgcccctcctcttttctaggacacactatatgtgactgtgactttcaaagacatttgtttgccatttgctgattttggggggaagttaatttctaacttctttcactaataaatgaagaaaagtattgcacctttgaaatgcaccaaatgaattgagtttgtaattaaaaatttttttccctgtcagtcattgtctcacatgcttagcatcgatttgcagctcagtagtatatggtgttcctagaatgcagctgaagacctggtatgtagaggaaataccaggggtggtgctagaagatagacatctgtggaatgattcacatcctttcattaggaggatagaggccttcttcattaagaagctgggggtggggagaacacataacaacatggggaccagtcaggggagtccccttatttctgttttgcatatgaggaaccctacagcagccaggtgaggctctctagtttaataaaaatcatggaaagagtcttttttttttttttttttttgagctggagtctgg

SEQ ID NO: 16421 - DNA, 1629 bp, Homo sapiens
ttggggctgtccctggcccctgccatctaaccgtgctccccttgcccccccagtggtacaggagctgcagcaggccatctccaagctggaggcccggctgaacgtgctggagaagagctcgcctggccaccgggccacggccccacagacccaggtgaatgctctccccacgcctgacactgcaggggaccacgtggccctgctggcttccacgtcgccctgtgggctggccccagcagcagtgatgagctggcagccaggatactggagtcctcaggtccccaggaaggtttacagttagccctgggcaggtggaggcagtttttgtctttcctggggccctgcatgtacacagctgcggtacacaggggctgcccttcctccagtcaaaggagggaggagggccaggaggtggccaggcagctctgggccctggttggggcgtctcagccgtgcctcctgtcccttcccctgtggcagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagcctgtgagtgggcggggtggggcttcagggggccaggcactgccctggtgcccgcctagccggctcagcctgtgaccctccccctgccctctgggttctggggagactttaaagccgagtttagaagtcttgggataaacacaaacttggaggcaggaaggtgtgaatttggattgttttctgtgggccctttaaggaaacagaattgtggacacacagtggttgagggtagggtgcatgcaggtacttcctgggtgttctgagggtggctgaccccagcttttcctcccctttccccacagtgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgagtgagccggccggggagaggaggggagaggagactggggaccctggcccataccctgcactccaccccacggcagtggggagcgagtcccagagtgaaccccacctcagaggaggctcctggctccgagtgggctgtaggggaacagccctgaccgtcaccctccgcctctcctcaggtgcagagtgtcgatatcgcagctttcaacaagatctgaagcctgagtgtgtgtacgtgcgcgcgtgcgtgaggccctgccacgattaaagactgagaccggccctctggctccgtcctggtcatttcctgctcgtacctggcctgtctccctccctgtctcagccccatctctgccctgctgttcccacacagtcatcctggctgctgccaccctctgtggccatgtcaccttgcccccagcagacctccg

SEQ ID NO: 16422 - DNA, 1252 bp, Homo sapiens
tccagcctgggcgacaagagtgagactccatctcacacaaaaaaaaaataacaaaaaaactcagaaatgctaagtgtacttatttgttgaagaaacttgttacatattactaacatcttttttttttatgagaaatacttttcccataaccaaaaaattcagtgagcagaatggccttgcttgaggtttttgcaaatctctcgggtgtctggcttagtgggaggcagctgggccctcatacctgcctccgcacttcagctgtttgacataaacccagcttcgtgtgagtgaaagggaagggcctggggaccctcagaggttctcggaccacactttgagaactcctcgtctggaagacaggcctggggatgccatgtggggtgagggcttacgggcttggtgtcgctttgtggagaaccgctggtgtctgaagcgggtgtcagccccactgcaccttggtgcttctgggctgtcctgatgccgaggcccacttcccagccatgctgactttgcctctttcccctcccagcagaaaaatggctacaaacttcctagcacatgagaagatctggttcgacaagttcaaatatgacgacgcagaaaggagattctacgagcagatgaacgggcctgtggcaggtgcctcccgccaggtgagagctgcacgtggggcggctgggcggctctgctgcccgacaggagtggccggggcacacaaagcggattcagccaggccaggaaggcagaggcaccctggcccagtggctctgctgtgggtgctgggagtggggtctcggggcaggcggccttggccgggcccccgggccgggtctgctcagggccctcctgccggcgcctgtgcacttggtgtggggccaggcctggcactccttcccccgcagacatgggcgcctttgcctgtcgtcacagcctcaggcatctcccgcttttctggcccgccaagctctcgttctgtgcagtactttcttgctgtctctatgtgagggttcatggggttttttggtttgttttttaattaaattcttttttaataataaaaaaaagactggttctttctgcactgtctgcaggagaacggcgccagcgtgatcctccgtgacattgcgagagccagagagaacatccagaaatccctggctggagtgagtacccgcggcccacggacctgcgggctcctgctcggccaagcagcatgtctgatttttcctgatgctgctggttgttttggctt

SEQ ID NO: 16423 - DNA, 1148 bp, Homo sapiens
aaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaaggtggtgctgcgcttgtgggttccagggacactgcttgaggttacaaagttccaggctgcctggatgagggcagggaagggctcagcacagggcagaatctctgccttgcccagggtccctctttggctgggaagctccccaagtcccctgtggctgtcacatgccagggctgagaagataaggctacttataggggcgggaagcattgaagctggtttctggccctagcgctcccctgcgatgagatgtgggagccagtgtgtccctgcctgtccatcctgtgcacccccagctttccttgtcacctgaaaccacctctgagggaaggtggtggcgtctcagatgca

SEQ ID NO: 16424 - DNA, 1242 bp, Homo sapiens
tggcctccaggcctctgcatgcctgccaccctgtccgtgcctgccaccgcccccatccgctcccgcagggcctccccacgctctgccgtggccctgcctcttcaccccccctcccccttcagccgggctctgtgggcctcagggctgggagcccacccgtccacctgggtggtttggggcagggctggcaccggcctgaccaacactctccccatcacagtcaccggactttgctgaggagttgaggtccctggaaccatctcccagccctggtgagttggggccgggctggggtgagctcccaggagcccagctgccctcagctcactgcccacctgtccctgccctccaggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttacctcccgtctgcctgtccatcccccacccactagcacagacccttcctgccctccgaggcgaggctgagctccgagggctgcaccctcaccgtccctcccacgtctcccgctgcgcctcactgcgcacgggtcggccgggcaggctgcccatccccagcagggcctcccccaagtgcctgcagacccatgtccgccggccggggcccgggactgccggagtcctggactggcacacgccaccgctgcccccacgcacgcagcacagatgcagcaccgcgccccggggcacacgttttattgggactggggccagcactagaggcctgtgcctggcagctgcacgcgcactgggagcagcacctgcagctgctcagctggcggccactggaccttggtgacgaaaaagaggcggaagtgctccagccgctgctcctggaactgcgtggggctatactcaggcccgtccgtgggccgcagcagcgacaggtacctctcctgcaccgcc

SEQ ID NO: 16425 - DNA, 1237 bp, Homo sapiens
cgcctgagagccccgggcccctccgtcagcgccacgtggcctgcctggcacgcagcgagagggggctgggcttcagcattgctggtgggaaaggctccacaccctacagggctggtgatgcggtgaggctggggcccagggccggggagggctgctctagagctgacagccgcactccagcctcaccggcagccctgcctcctccaccctcccctgcagggcatcttcgtctcccgcattgccgagggcggtgctgctcaccgcgcgggcacactgcaggttggcgaccgcgtcctctctgtgagtggggatggggccccgccccacccacccatcccccctgccccgccccgcgccctctgtccccttctgcccttgggcctccctgattcgggcacgctctcacagattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggtgagacacaagcccccacccaggcacccacccagcttcagctgtgggcactggccttcccaggacctgctctcttatggccttgcggcccactccaggtgggaagccggcctgctcgccctttcccctgcagctccttgaggctggggctctgccccacagccagactcctcagtatggtccccttgacacagtctcctggctggccacatggccacagtcagcgaggatattgtcctcacgctgcgtgcctgcctgggcagcagaacactggtggcgcagaaatccccgtgggcattagggcagcccccgcccgccatccccaaggaccgggacggactcttgggagccctcccacaccctttccctgtcctgaccgaggcctgtccttgtcccgccctaaatccccaggagatccgtctgccaagagctgggggccctctggggcttagtattgtcggaggctccgaccattccagccacccgtttggtgtccaggagcctggtgtgttcatctccaaggtagggcggcccatccaggcggttctgtgagaggtgcacccatcccagg

SEQ ID NO: 16426 - DNA, 1188 bp, Homo sapiens
gggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggaggtaggcagaggggcagggtggtggcgggggagagggtaggggggcggggccgcagtgctcagctgtcttcccctcggccctgccccacagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaacgtccgtgtgtctgccgtcggtcctgtcaccgatcctgggcgtgtgtccttagggggtctagggcgaggaggcagggttgggggggtctctggacctgcttcctgttggcaggaggggcctgccgtgggcgagacctgggcagggggttggcgccccgggccccgtcccgcgggtggcggcggctgggtgggcggggctgcctggggcgccaggctctcgcgcgcgggctcgcagccgtccccgcagggtggtgctgagagaaggctgggcaccgggacaccgcgacccgctggacagcgcgcgctgccagtgcttttgtgccgcagagccggccgtccaaggcgggcgggcgggcatggtcgcttcccgggaggaggctgtgcgttaagattcgtggccaaatgccgcggggccaggggccgggctgaagaccggagggcggagggcgccgcctctcgtggattgtagctcccaatatcccgcgcgcggggcgggcccggctt

SEQ ID NO: 16427 - DNA, 1179 bp, Homo sapiens
cctttggccccatcaagagcatcgacatgtcctgggactccgtcaccatgaagcacaaggtcagcaggcttggtccgccccggccacttcgggctcgcccccacccctgggctcgcgcagcctgacaggtgtgtccctgtgtctagggctttgccttcgtggagtatgaggtccccgaagctgcacagctggccttggagcagatgaactcggtgatgctggggggcaggaacatcaaggtgaggcagggagccaaggcctcgatcccgcaggcgtgcagggctgcccctccacggaagccttttgtggccgggcctgggttgaccggtctttccatctcaccgcctcttccccaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattggtgagctggggtggctgaggcgggatgggggccacctgaggctggggctggccctgctcactgctgctcctgcccacagagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggtgagggcccacacagctgtcggcttgagggtgggcgggctggcccctgattccttggagactgattcaaggtggtcttgagtagccagaccagggactgagcacggtgaccttttgggttgcaggaagcagtggccggagcagcggtgctgggtaccctgggcacacctggactggtgtccccagcactgaccctggcccagcccctgggcactttgccccaggctgtcatggctgcccaggcacctggagtcatcacaggtgagtcttaagtggtaccagatcctctcctctcctgtcctggcatctctcggctcgctgccctcagctgcctggccc

SEQ ID NO: 16428 - DNA, 1844 bp, Homo sapiens
cagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttcccgtgcctccggccttgtgtcttggggtcaggtgtgtgtcagggacagggtggacattgcagccccaggctccaggctctgagctcagccactatggccagtcagggacgtacgtctgtgtgcagcagagaccaggtgctcgcaggagggcagctgagagaccctgggcagagggattcagtgtggggcagggtggtggccacactgaggccgggccccctgggacctgctgctggtcaggtgctgaccagtctcccagccccacccttcgcactataaggggctcacgtttccttatctgaggcggggtgtggtatgctcccatatcagtcactggctgtggccccttggcctccggggagggtgccacatggccccgggtcagttggttgctgctggccgggcagccctccagagaaggggccacaggcagtgggccta

SEQ ID NO: 16429 - DNA, 1185 bp, Homo sapiens
cgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcg

SEQ ID NO: 16430 - DNA, 1139 bp, Homo sapiens
caggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgagga

SEQ ID NO: 16431 - DNA, 1598 bp, Homo sapiens
ggctaagtactctggacttggtcccaatcccccagaaggccagtaggaagatgtgtgaggtgggcagggagggaaggggaaggacagggatggaggcagtggcccactgaggctgaggaagcggctgagggtggccgtcttggccggggcccctgtgaggtcagagggggatcagctgtgctccgagtcatggcaacgaccttgcaggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcaggtgggccccgccctgccctccctgaagcccaggtacacacggccccaggcccgccaacacctacctgagtcctctgctgccccagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgaggtgggtggcgctgagcgatgggcagtgcgggggtgggccgggcccagccactgcagacctcaccgtctcatctgttgcagggccagctctcccccgccacccggggtgcctaccgtgactgcctgggtcggctggacctgcagtacgccaagctgctggtgagtgggggcagggccagccgggggaggtgggtagcccgcggcctgctgacacgcaccctcctgcccacagaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggtgagcggtggcccagctgccctgaaccccacagccccctccccagctgtgccctggccgtcccctatggtcagagaccagtgggggccctgggtcgagtttgctgggagcgtggcagagccgggtgtggccggccgtccctgagaccctttgctctggtgccaggcgctgatgcgggagctggagctgaaggagaagaagatcaaggagctccaaaatgctggggaccggctgctgcgggaggaccacccggcccggcccacggtggaggtggggctccctgggtaggggcggggctgcggggggggccgtgccgggtccccaggcggggcggggcggggcctgaccgggacctgctgtcccgcagtccttccaggcggccctgcagacgcagtggagctggatgctacagctgtgctgctgtatcgaggcacacctg

SEQ ID NO: 16432 - DNA, 1192 bp, Homo sapiens
agtacatggccccgggggcagggggctgtgggctgggggcacccccacagcgcctccactaggcaacttcagacacgttggggcagggaggagggcaggaggaacagggatgagtgccagctggccgcctcggggtggtggagttcagggcccagccccaccctggtgtccttcagaagcaccaccacttgatctcaagactggagggcccgcgggctgctggtcctcacagccaggtgcatgtgccctctgtggacgcctccggaggggcctggtggggagggtggctgcagggaaccccagctgcctggcaccctcagctctgcgcagtcctctgtgctgtgcccctgggcttctgggtgtgggggtggcagggtgctctcagctctgcccatgtgacagtgtatttttcagggtgagtgttgggggggtccatggttgctgggatgtgtgaggagccggcctgtgcacccgcctgtgtggtgtggccgctggtcttgtcccacccacctgaccagccacctgcttgtcccaggcccctgctcatcgacatgaacaaggtgtaccggcagaccaacctggagaacctggaccaggccttctctgtggcggagcgggacctgggagtgacgcggctcctggaccctgagggtacgtctgcgtggccttcctccctgtcccttcccctgctgcctgccccagagccaccgctgagctgcccttccctgcagacgtggatgtccctcagcccgacgagaagtccatcatcacctacgtctcgtcgctgtatgacgccatgccccgcgtgccggacgtgcaggatggggtgagggccaacgtgagtggggggcccggagggcagggggcttgggcctggacgccccgacgacccctgacagccgcccgtgcctgcccgcaggagctgcagctgcgctggcaggagtaccgggagctggtgctgctgctgcttcagtggatgcgacaccacacggccgcctttgaggaacgcaggttcccctccagcttcgaggagattgaggtgggcctgccgtggggggcggggtcctgggcctgccctgagagcccggcgtggttgccgacagcctcgtccctggcagatcctgtggtctcagttcctgaagtttaaggagatggagctaccagccaaggaggccgacaagaacaggtccaa

SEQ ID NO: 16433 - DNA, 1108 bp, Homo sapiens
actgtggatgcagctgcatgaggctggaatgggccttgaggagcccgggggtgcccctggccccagtgtaccccttcccccatcacaggtgatggcacccccttctgttgttggaatgggcttctggggtctgactggtgtttagtgttgcaacttagcctcagctggtgggatggtggtggtctttggggatcccctggccccagggtccatctccaagagcctgtgtgccctgcagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccggtaagaggctgggctggttgttgggggcaggggtagaggtcccctggacatgcagacagcttgtgggttgcctctgagtcctttgtcttacagggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggtatgtatggatcagccccacttcccccaatgcctgtgccctcatcacagaccgcaccctcattcagtagccctttcccccaacctggtgcccatgcccccaccatggagcctaccttgatgttgcttctccacccaggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccc

SEQ ID NO: 16434 - DNA, 3317 bp, Homo sapiens
aagcgctaggacccaaggcgcgcatcacgcgtcgggccatgagtcaagggaatgaaggagaacagggtgctcagcctgggggcccagcctcccgctgtcacgcgctgcctgcggccgagacccctgcccgcgccctctgccgggctgccctccaagccgccctttctctggaggtcctcagcctgcaggggcaccctccacccggccatcgcgcagcctgggaaggtggagaaaaggagcgtcggggtctcggaggcggcgtgggaaacgccgggcggagcgtggcgctgtcacggcaacagagagacgcgacggggccccgccccaccgccagtttccacgacaacccgaagagcgtggggaggcaggcggtgccccggcccctgactgacgcgaccgggaccagcgcgcttcgtccccgcccacccgacaggccccgcccccgagcccggccccgccccgcgctccccggctttcgcgaggttttgactctcgtggcgccccaggggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcgtcccgggcagctcccgctacggacacctcaggtgagcgctgggccgggccccggcctccgcgcggccccgcatctccgtgaaggtcacggcggggaggctgcgggcgcgggcctgggcagcgcggaagcggtaccggccacccagcgtccccggtcccagctgcctgccgaccttgagcgtgtgggatcagggctgggcgcccacctctccgaacggcagagagcccgtccccagcgtgggggttggcgggacgggctagctgccgtggcggggctggggctttcccgaatggcgcgcccaggacggctcttgcggctggctgtccaaactgggcccgcgtcctgaagtgaccccagcctgatctcggccagctgcttgtgaccttggcctgtcccagcacccttggtcacttcggtctgatccccggctcaggatccaggaacaccctctcctgagagcgaatcacggtctaggggtcagcggcggagagggatggggtgggtagtgggacagggtgtgcgtctggtgccctgcaggaggaggccattgctgggtggagaggtgggcgctgagagtcagatccccaggtagggctgggtggtgtcctggcaggcgctgagcggagatcttgcaggcagtggccttgtcgtcgaagtctggcctttcccgaggccggaaagtgatgctgtcagcgctgggcatgctggcggcagggggtgcggggctggccatggctctgcattcggctgtgagtgccagtgacctggagctgcacccccccagctatccgtggtctcaccgtggcctcctctcttccttggaccacaccaggtgtgcagctggctggctggctggcagcgggaggttctgggtggagctggtaaggtggaatcttcagctttcctaaccctttccctccctccagcatccggaggggtttccaggtatataagcaggtgtgcgcctcctgccacagcatggacttcgtggcctaccgccacctggtgggcgtgtgctacacggaggatgaagctaaggagctggctgcggaggtgtggggtctggggatgcctgggacccagggctcagggctcccactgttgagatggcagggttgtgatgaggctctcggtggcaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggtacacgggctgcccatggggtggtgctggagagatgggggaagggctgacttgtgcttggaactaaggagccatggatctggtcctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggtaagaggcctccagtctggcagtgggcatgtggaatacttctccactacccccagggatgctttccctgtgttcctgggtccaggaggtcctgcccacttcttgtctggggcgtcttctgtgcatgtctcaggaggcttttgggctccttcagttttgcgtatgtccggtggagggtactgcccctttgatgccttgggtaggggcagtgtctgcttcacagagggggggcatgatcccaggttggacatgagcctgagaatagccctcactgcttgtcgttggccaggcaccccagctaccatgtcccagatagccaaggatgtgtgcaccttcctgcgctgggcatctgagccagagcacgaccatcgaaaacgcatggggctcaaggtaaaagggttgggaggccatggtgggtatcagagaagggctgggagctgggcagggctcctccccactcccttctctgagccttccttgtctgcagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgtacatatttgagttattatatggaaagagtgcacgtttgcaaggaactctgataccaagacccttgccttcacaaggctcccaggatgtcccatgcagtgtggccagcaatgccctgcactgactggtagctgggagtccagacagtgggtgtgggacagaaagcggagaactgcatgttagaggaagtcagcatttggtggggtggggtgtgtctgagcacagagctgaaaagggcctagccaggcaggatgtggcccagggacctgttggaatgaacagccaagtgttaaggtgttgaaccacttggcccccattctgatggcagcagggaaccttggctgcatttt

SEQ ID NO: 16435 - DNA, 1173 bp, Homo sapiens
cctgaaactggtttccctgcctcccctcagtggctccacctacacaccctcagaggcaggcaacgagctggacatggagctgggggaggaggaggtggaggaagaaagcagaagcgggggcagtggggccgaggagaccagcaccatggaggaggacaggtgtgtgatgggggccatgacccgggtccttgaagcctggagtgggtacaacagggtgggggcctcctctacttggtctaagtggtggctcctgaaggcccactgtgtgccaacctccgcccagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttagtgtggacctgatgcggtgtgggggtggggcctgcggtgtgggagtggccggcggcatctggtatcctagcaactgccgctgcgggccgtgaccgctaagtcctgggagctgttgggctctgggaccgcagttgctgaaatggaggcagaggtgtgggaggcagaaggctacaacctagttctggactcggacctgtatgatgcggatggctatgatgtcccagaccctgggctgctcaccgaaaagaatggtgagggggcctggcctcgccctccgggcatcccgctaggaagtgggtctcattcgggcttgggttccgtcccctggaacaaaactcccctgggcagtccctggtagggcagggc

SEQ ID NO: 16436 - DNA, 1173 bp, Homo sapiens; identical to SEQ ID NO: 16435

SEQ ID NO: 16437 - DNA, 1202 bp, Homo sapiens
tctccgagacgctgaagagcttctgcctggagcccgaggcccgcctgcaccctgccgggcctgctcagctgcccggagagccgccgccgctggaggagaccgactggtcgcactcgcagctgctggacttgggccccatcgacgcgctcaacttcttctgtgagcagctgcgggcgcagcagcggagttcgctccaggagaaggctgcgcacccacacccgccagagccctacacggtggcgccggtgcccgacatggtggtgccacctccgcgggagcactggtgcgcggggcctgcgccggcggggcctgcgtggggcagccaagcgtggggctgggccagctgaaccctcctctttgcctccaggtaccaccccatcctccggctgcaggaggccaagccgcagaggtccgcgaggtccgcgatgagactgaggggtgagtggagccaggggtggagactggaccccacccaccccagcccccgggcctcataagcctccgcccgcccccaggccccatgcggtcccggctctgtgcgggccgcaccctggacggccccatccggacgctgaagctgccgttgccgcgtgtggagccgcagcctttccccctggactggcctatgcccccgcgcccgctgcccccgcggctcctgcagccggccctgcagcgctactttctgccagcggacgcggaccctgacacctacagctgaccggactggtggcctcagcccgcctggctctggggcctgtcattggtatttggccaaggcctgcatcgggaataaagtccagagaatttctttctgcaggatgccgcctgctttggagggccccggggtgcgcacggcgtgtgggcgtgcggcctgaacccacagtggcggcggaaggcaggagccggaggcctggcggaggtggccatcgtgggcaccagcgttcccggaggggtggccggcctagggcagaggagacccatagcggggtaccatccgctgggcactgagcaaacgttttctgctcaagtactaggtgttgagatgcgggctgaccttagagaacgtgtcctgggccagcccacagcctggtgtggaggggagtccgggagggcctgggcggtcccaggatgagccttccgggtcgatgcaggtgagaccaggagtttgcagaccttgctttcgttacttttattctggcaaa

SEQ ID NO: 16438 - DNA, 1169 bp, Homo sapiens
ggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgaagcccagggcgcccgcgcgggcggggaggggacggaagttaggggggacggccctaagtgacacctcccaacaggtgcgtggtccagcggctgctgccccttacccagtaccccgactcctctgtacgcaggggcggggtggtggggacgctgcggaattgctgcttcgagcaccgtgagtggtgggtgtggcgggggtgcgttgccaggtgtggggactggactccggggctgctctggaccagtttccattcccgtctccccaccctcaccatccctcaggacatcacgagtggttgcttggacctgaggtggacattctcccctttttgctcctgcccttggctgggcctgaggatttctccgaggaagagatggaacgtgagtggctagtgtggagcctcagagttggccggagaggagggaggccagtggagggagagagaggtgtccaggccacaggctcctgaaactttgcagcagtgagttgctgagcacaggtgggacttacacaggcagagcctggctcagctgcccagcccagggacacagtggctcccacacactcacccctagggctgcctgtcgacttgcagtacctgccaccagacaagcagcgagaacctgatgcagacatccgcaagatgcttgttgaagccatcatgctggtgag

SEQ ID NO: 16439 - DNA, 1060 bp, Homo sapiens
tgctgactccttcttctcctagtcaggtctgctcttaagcccctctggttaatttttttttttttttttttttttttttttgagacggagtctcactctgtagcccaggctggagtgcaatggcgcgatctcggctcactgcaacctctgcctcccgggttcaaacaattctcctgcctcagcctcctgagtagccgggattacaggcatgagccaccacacctggctaattttgtatttttagtagagacggggtttctccatgttggtcaggttggtctccaactcctgacctcaggtgatccgcctgccttggcctcccaaactgctgggattacaggcgtgagccaccgcgcccggcccctctggttgacttttaatctgagttattatactcttcagctccataattttgatttcgtgcttctttacaatttttatctctttattgatactctctgataagatgtcattctcatactttagttcttcagatgtggtttcctttagttgtttgaacatatttgaaatgattgacttaaaatctttgcctcgtaagtccagtgtccaatgttttggcttctttggggacagtttctattgattgcctttttttttttttcccgtgtatggggtatgggtcctagcttcttgtttctttgcatatctctatttttttttttaactagagttttttgtttgtttgtttgtttgtttgtttttgagtctgttacccaggctggagcgcagtagttcaatcacagctcactgcagccttcacctccggagctcaagggatcctccctcctcagcctcctgagtagctgggatgataggtgtgcgccaccacgcccacttaatttttgtatttcttctagagacggggttttgccatgttgcccaggccagtctccaactcctgagcttgagcaacccacccgcctcggcttcccaaagtgctgggaccgcaggcgtgaaccagcgcagccggctggaaaactggaactctcatcggttgagagtggcagctctggagctcggactcccccacctccccagg

SEQ ID NO: 16440 - DNA, 1218 bp, Homo sapiens
caaggagatgcagctgtacaacagcatcttcagcctgctcagcttcgagaagattggctacacaggtgaggcgccccgccgcctgctgcatgccacacaggtgtgggttggggggctggcagccaggagtctgggggcagcaggctctgggcactgggcactgacagcgccggacagccgggctctggacaagctcccggtggacaggtggacacctcggtcgagaagacaggccggagactgagtggaaggaggggccgaggcagaccccaggtgcacacctgtgtggctctcacagcagccccgcccacctgtcctcgccaccctggcttcaccatccctgcaaggtggcatctcactgtggggctccagagcctcaagacagtcagggtctaaccagaaagtgggcaggtctcagggggcctgggagctaggggcctgcccctcggaccctggggcaagaagagcaccctgccgagtgaggtcctacctgcaggcagtcactgccccggccatgggcctctcaaggctggcacgaagccattcagggagagggctccacaacaagctgagggtgcccgactcaaactgtagaaccgggagtggacacccacagacgcccaggctggatgcgtgcgcaggcacactggatctcgtggctctctgggccgctgccaccgcctttgaacgtgtcggggagcaggagccaggccagagcctggcccagaggacagcgagaagcacctgttgatgctggggccactggaggaagctccatccctctactctcagcccacaccaggcggccagctcagagcaccaggcgtggcgcaagcagggtggtcgtgggcagccagtcccgccctgctgcctggactgtgcccagcgggatgtgggcccgagcaggccagagaggccgagggcctggggtctctgcggcagccacagcccgtggtgagtagcagccttagctgtcctggagataccggggcctcgtggagtctaggcaggctggggcactgtggctgtggccgtggccaggtgagaagccccattcgcgcaggaaagactggccacctgggaacccacgcctccacggagggacttgccggccacaggctgtgggctgcccaagaggactgtgcaggcagggctgcctgctgattggcagctccggatcaggcccggtgcctgcagacctggtgctcccctcgggca

SEQ ID NO: 16441 - DNA, 1199 bp, Homo sapiens
gccccagtgtgggagctgcatccgctccccacctgacagtgatggccaagagcccagtgttcctggagggctcccaaactctggacctgtaggggggtcagggcagtcgctggtccctaagggaaaagcgtgaccctcggccccaggtggctgaacccgtcactgccagggcgagctgtcacctctgtgagctgatgaggccttgcttttaggacctctaatctctgcaagaacccaagctggctctgcctgtttctcctgagcagctcgcagtgttcaccacactccagcacgactcgggacaggcacgtgcgcccctctgcaccagctggagtccctcaggacacctggctggagctgatgggcatgggcgggtgtgtgcgagcatgagcccgcaggtctgtgagcttcgtctccctttccttcttcgcagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacaggtaactgagggtcaggggcttagccttacaggcggggcccaggactgctgggagcccaccctggtgcagcagggccctgtgcagggtggtctggctgtctctgctgtctgggccttggggaccacctgtgtagcccagtgacggccctgtgggagggtgcctgcacaggatggggacaggtgggttttgcacccagttgttatccggacatgagcctagccttccagtgctctttgtggctgtgggggagccccttgaagggcccaggacagcgtgtccaacgcaggacctcagggagcttggtgtgagggtacactgcccatggctacccatccagtggaggcagccaccaagtctcctgcagtgaggctgtgcaggaccaccactgccaaacagaggagagaaccacgccatggtgcggggcacacaggctcaagcttgcactcttccttcccctctctctccctttttctgcctgtctcctttctctccacatgctgccactctgacctcatcctggggggtgg

SEQ ID NO: 16442 - DNA, 1282 bp, Homo sapiens
ccctcgctctcccattggctctagtccctgcgctttcttgccccaagcggcgctcccattggccccgcgtggggctcacgtgacggggaagacgagggggtggtggcggcggggcggggggaagcgcacagcgaaaacaaagatggcggccgtgccggggtcggtggccgcggcggctgtggggctacgcgcgggccgggcccactgaggcggcggcgcagggagcggggctgcgggttcgcggcggcggcggcaggagagcggcgggagcgcgcggcgcccctaacttctagtcgggggagcgcgccggcatccgcccgccgggccggccggccgctatgtccggcgccgaggaggccggcgggggcggcccggccgcggggcccgcgggctccgtgccggccggggtcggggtcggggtcggagccgggcccggggcggccgccgggcaggcggcggcggcggctctgggcgaggcggcggggcctgggctcccggacgaggcgggcttggcgggcgcccggcagctacagctgcaggaggcggccggcgaccccgacgcgccgcccaagaagcggctgcgggcagccgaggcggccgaggcggcggcggcggcggcggcggccggcagcgggaaactggaggagcggctctactcggtgctgtgctgcaccgtgtgcctggacctgcccaaggcctccgtgtaccaggtagggccgccggccgaccccgacccggcccagcccggggctgcagcccccgccgcggggccccaggatccgcgtctcctcggaggccaggcctgcggggcccggcggccgggaaccctctctggcccttacagccacttcctcgcccagcggggctccagcggctgctccgaagctcctcgttgtctttctctcagggctttattttccgctcgggaccccccttttctgttttctgatccacggtacttcccgatctgaatcgcttgtcttccgcttacctctcccttcttttttctagacttccccacggtcccctgaacactctcccaacccacagcctcaaactgatccttagcccgcaactgctccccgcaacccacccggtcccaagctccctgggctcagagtcctgtgctcgagagctccttccccattcttccggcagccacacccccgagtttgtccctccactcctgaacatcctatggacgcctccttttctaccctcctgggtggaagaatcctttctcttggtccatttccagttcatcctgaagaacagtaaggag

SEQ ID NO: 16443 - DNA, 1400 bp, Homo sapiens
agccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccactcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaatgccatgcctgatttttgggtcaggagtggtgacttgggtaaccacttggcgggggggcctgggattccctgctgtgtgccgtgataacagcaaatggtgataaggagaaagccaagacctgtggcctgatgcagggctgggggcggggggtgatcacttcagcaggcacaacacacttcactggctgcggaggtggaggggtgactctgggagctcaggggcaatggatccaaagaggctagggagcttgtgccctgggagacggggtacagggactttactaccgcctctgccagcagagacctggcctgagaccccatgggcagggccgcgacccaggactagaggggcaggccctctgcgggcgcgagagccgagcccgagccgttgtcgggactggggcatggaggactgccaggggacggcgtaggggtgcagggggtcccggtgagcggagtgtcggtgctgagggaagaaggcgtcccggaggagcgcgggaccc

SEQ ID NO: 16444 - DNA, 1121 bp, Homo sapiens
cgctctttcgcctcccgagcggggcctgctcctccaggtcggatgcgtctcccaccagggcctgacgccgctccgaccggcccggggactcccagtccttcccggcccgcggtggcacctcccaggctcccggcctcggccccgggctcccaaatgcagccactgcctccctcggccaggccgccccgagcgaccggtgccccgccccttgaggccaggcagggccaggggcgtgcgccgccccgctcagacacccccccggccgcccgcgctcaccggtcccgcaaccgcagccaccgcctccagccccgcctagaccgtccgccgctccccgcccggcgccgcggcgccccgcgatgacgttgacgcctcccattggctgcttgtccgaggcccgacggactggctgcccaggggcggtggccccgcccccggcccgccgcgcatccgcattggctgtcggcccccgcgacggctgcgcgggagattcgctggacgatcgcaagcgcggaggccgggcgggcgcgcgcgccatggagcggctgcgggacgtgcgggagcggctgcaggcgtgggagcgcgcgttccgacggcagcgcgggcggcgaccgagccaggtgcgggctgcccaggggccgaggggctgagggcgcggcccgcggctgacgcgttccctttacaggacgacgtggaggcggcgccggaggagacccgcggtgagcgcgcggcggggcggcgggggcgagaagacaccgggtcggcaggggcccaggccccaccctgaccccgcctcccgctcgcccacgcagcgctctaccgggaataccgcactctgaagcgtaccacgggccaggccggcggcgggctccgcagctccgagtcgctccccgcggcggccgaagaggtacccaggccccgccgccccagcctcctcccacttccctgtttggcggagtggcgggagccacggagtcgcggccaggccgccgtggggcacagaacttgggagggggactgggcaaagtgaagaagggccgggcctcgctccaggtgcgggaggggtggctgggagcgcttctgccgccacaacagccttttctggcctgtgcccctgttgtctc

SEQ ID NO: 16445 - DNA, 1241 bp, Homo sapiens
ctgaagtccctctcctgcaggtggccgtctgcccggcccagcaccatgcacacgcttgtgttcttgagcacacggcaggtgctgcagtgccagccagctgcctgccaggccctgcccttgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggtatggacttatctggagggtcgtcaggccaggggtgtgtaagtgggtcccctgaggaggcttgggtcataaagttagcaagagctcatgcaggagcaggcgcgttgctcctgtcccaaggtggctgggagggggtatgggcgctgcccctccaccccttcctcacaccattcctactcccaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcaggtgagcgggccccaccactgccctgcccctcccttctgtagggaccctccctggctctgcctgtctgtgacccctgtgtcccctgtagcaccctgcaga

SEQ ID NO: 16446 - DNA, 3353 bp, Homo sapiens
acaccttcagccgcgtctcctggtgcgcctgcgcgggggccctggaggaggagaagtaggcggggccggcggccgctggtgactacaagccccggcgtgcaccgcgctaggctggccgtggcgcgcccggaaggtgtcgcggccctgggccccgccccggaagataaggccgctcgctgacgccgtgtttcctctttcggccgcgctggtgaacaggtaggtcatccttgcggccttgcggcatgggcagtatccgccgccatcctcttccgtgaggcgcgctgagacccggaccggccctcctgagaggatgccggtgcgggcgcccgcggagagggtagggagtggtgggcgcggcggcctcgggggcggggtcccggaaagccgggctggcgggggtacccgggccgcccggccgcgctaatcgtgagtcgcccccaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggtgcggaacgctggccggggcgggaggggaagggacgcccggccggaacgccgcactcacgccgcctctgcccacaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaagggttagcatcgcggcggggaaggaaggtcggggtggggaggggtctgggtgttgcctgaggagttaacgtcctaagccgatatgggaacctcgcaggcagaagcttcaggtggggacatccgcgtggccagaccagtggccaccggtgggtgccgagagagttgtaccgggaggctggatgttgaatgctgtgctcgcaacttcgcgggttgcctagagcgagggggttcgcattgtttcttactgtgctgacggcctgatgctgcttccccttgcagcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgagtatcaggcagcagttgaatgctgagggctgtgggtgaacatgctgtgagtgccggtggacagccagtggctagacttggtccctggaattcgattacctgttgttctaaaacttgggttctgtaagtttgagctcatcctgtagtctcagttgtcatcactgtacaacaggcacaacagtacctgctttactgctgttgaggcgttaaatgagattgggacgaagtcaccagggtcttggattctaccgtgggcttcctgattgctgcacttgcatgcagttggttaacagcctttttagagaaggcagggagagattgtggctttctcaaagacgcctactgagtgagtgaaaaaggatttgagtctaggttaactcactgtgctgtttgggaacatcttggaatccttgtgatgaactcagcctcgcacaggggaggctctgaggttgtgttcctggaataagtaaagctgagatggggcaggctgaatcaagtgtcttacgtcaggttgagtggccggcctgacgtctcacacatggtgaggggggtgcttccctgcgcttggagctcagccagcattctaggtgatggaggtgagggccttggcttgcctgcccattgtggattgaagaaactggatgtcagctcacagggtgcaaggggctccctagggtggaggcgagtgggctttttgctgggtagttggatgcagtattgggaaggtgcatgacaggagattgaggggaggtgggggtgctctgaccgactgggggttccctgaggtatctgatcccctacaggtgtggtggctggaggtggccgaattgacaaacccatcttgaaggctggccgggcgtaccacaaatataaggcaaagaggaactgctggccacgagtacggggtgtggccatgaatgtaagtaacccagaaatgcagggttgggtattgaagttacagtggccacactgttgggtaggcaagtcccatccacaggtgtccctgcaggagggggatctacggtgggaggagcagcaggtggtggtttgtagtcacgggactgttgatcctgctccagcactcctgaaggaggtgggctcaccctccttcaccgtttctccgcaagaaacggaggctgggaggggcagtgggggcctgagctggaaagagtcagcctgactggggttgtctagcggcacatgctgtggagaggggcttcgcggaattgggcccctgacgggtgggaccccgaggccgggggcgggggtggtggggaagaggtttctaaagccatctttctctgcctgcagcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccacctggctgtgcccacccccatggtttcaaagggaggggtccctgctgggaggatttctgtgggatccccctggttggtactgggagggagttagactactgaagtagaccaccagtgagtggtagaagcttgaagggaaagtccacaactagaaacggggtgcaggtaccctgggcaagacccttgcttccccacagaggggaccaagaatgtggcatccaggacctgacacttatgtgggtgactcagtcccatggcctgcagtgcttggatgtgaacactcatttcacgtatcaggaaacagaataggacacaatcgttgagcctggtgttctggaccataccctcactctgtcagctccctgctaactttctcagcacctgaggcagtcctttgcccagggtcttttagcgacaccctttccctccatactggctacagccctgctgatgtcagtgtgtttaagtcactgccagggatacctggcttgcaggtgtctgccttgcactgggaacttgggatgggccctgaaggaatgt

SEQ ID NO: 16447 - DNA, 2094 bp, Homo sapiens
gtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggtaggtggtaccctgaggacctgggaatgaggaaggatgggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattctttgtctttcagttatttacttgctcattatttatagaactgcctttaaaaaatcctaccctgtttgtacccactattaccagtatattagcaattgaaatactggcataaaatgttttcagttaaaacgtttatgagaggagagactccattaattcattct

SEQ ID NO: 16448 - DNA, 1100 bp, Homo sapiens
gtatagctagcttttcttccagcaatagtcactcacttgttcttcagatgaaacccaagtggagtatttggccttcacgtaggaaacaggctgaacaaaacaagtattgatcactcccctctcaaactccggtgaaacatggaacagtggtcaattcttgacacacacatggcttttcacatttttccccaagacttatgatcattaagtagaaaagacagaattagtcacactatcttatctcactaccaagcaggtatagttgaattcaagttaaatgcatgaatgatacaactcagtattcttttgtatctgactgacttttcttctaagcactctgagtgtttgaatgaccaactcaaaagcaaggtccattttaaagactagagttgccatcagtgagtgatcaccaagctcattctatacttcttcttttccacagatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatggtttg

SEQ ID NO: 16449 - DNA, 1237 bp, Homo sapiens
aagtggaatttaatgagtaccggggcagtggggggttcacagctgcctacctagctgttttatggattaggttccatgctagattttgtttgaaagccactcaggtaagttaagctcataggaggaaatgtgctaaatgaattaggggatcactgtggattgcggtgttaaagtcagggtcactgggaagttctccttgtctctgattttgggccttccaagtaaatagctccttgtgattagactttctcccttgagactgtccctaaaatgtcaaagcctatggagtttgaataagaaggaagaaggtggaaatttgttacgtgcagaagtttaactacagctaggatgtttgaattttaaaactgcagttgtttgagcaaacaaagcttagaaggattggtagctcagtcaggctcatgtagtcatgcctatgagtatctggctgctttctcaaagtagtctaacggggtactcactcaggtctgtcactgcagttacacctgctgaggaattggctgtgcctttcctttccagaccatggggtcccaggactactccagcctaccgactaccaggacccctcctgccacggtgtattgaatccttcccagactgcaaaagcgctgatggctgtaacttttgacatggattctcacatcacccaatataagggtgtgggtggagagctggaggaactgggatgggataaggaggtgaatggggaaaaggcaacagtagagcttgcatttgtttggctaatacattgtgatttgtgttctctgtataaagaagccattcagagaaagggggaaagaacccctgctctttgtttcatctttgaaactaagataatgtgtacataatttgaggagtacttttataaagcttatagcagaagcagcaatctaccccattcctctgcacccctgcctcaccctccccagaactactgattattcttcgctctgctaaatgtctaaatacatctatcagttgcaggtattttcttttgatttcctattacaggaaatgcagattaagaacttttaccatcactgttccccactcctcttccctcccttcccagtagaattgcatcatgtatgatgaaatcagtgttcagggtttaccttattatacctacataaatgttgttaaatattgattcaagtagtgagcagccattacatttcctctactattttaatttttctggaattagtcatttattttc

SEQ ID NO: 16450 - DNA, 1189 bp, Homo sapiens
tagacctgagtttagtttaccaattttacttaaatagtaaaagccacttacaaagtgactgcctaggatttttttttcctttcatttgaaataattgataatatgtttttttaaaaagaaaaatgtgttttgtctcttcttttatttggttctggtttgattctttttctcccctctttcctttgttttttttttttaaataaattatgatgttgggattggaagccctgagtaatgaaaatctttggtaagaattgtttatgtagctcaataacgaggacaacaaatattctttagaagaattttgattctggggaggaaagaaaatataaaaactcccattgactgttgataaccaagtaaatttttccttcagtaaattagtatttttgaagaaacgatcgccttgttttaacttgctaaacaacaattttaaatgacccaataaagaatctattgaactttattcgtttaaaaagcatcttttgtaccaaagcaaatttttttctctactcatttccatcatcaatttggacctatggtggtgaccaatgcattggttacagaaactttaagtgagtgccttgagaaaacttggaaatttgtgcctgaggtggtaaacttttaattaggttaattgtagtgcttaccaatcagtaacttcactatcactcagggctttcgtaccttctaggtaaaacttctttcattgtgtttttttaagatactgtatttttttttaagtgccatcatttaaatttcacttagtaagtggcagattacattattcagtcccacaagcacagaaacatagtaacactaggagatatttgaacatttattttacaatcgactgaatatattatgtaaatgaggtaagcaacttttgtagagattgtatgtgtgagataatgtaatgttcttttccagtttttggactacagttgaataaactttttaattatttaaaaacatctttaccgaataacatgtgatggttttttgtataatgtatttgattttgtaaatacgtatttcctgatgtgatttttgtgagaaatgctaaatcttttagtatatcatgtcctctcaaaattggcaggagctaaataatagtttgtgggcgatttgtattgtgtactgtacaataactggggaacttttataattataaaaatatatattaact

SEQ ID NO: 16451 - DNA, 1711 bp, Homo sapiens
tagcacggtttatgcacctctctttagatggtgtactttaaaaacaaaagtaaaatttagaaaatggttttaacactgcatacctaaaattagtagtgtgcagcattgactgcctttgatttgtagtagacaagtaaaaatgaatacgttcttgtagaatgctgtaaaagttattcaggaatgaatacggttttagtgccgtaatcatgaatctttttatatgaatgcactgtctaaaagtgctaaatgcattttcaaatttttaaaaattcctcagatgatatatttgaaatgtctaaaataatgctgtgcttgaaacattagtgtaaaaggaaaaaaaaaatagtgtcactgtgatgttggtcctccctgtgtggacacaagtagaaagaaaaaacttggcaagtcacctttgtgtacaatttgaggcagtggttatatacaataaattgacctttattatatcccccagacacacacattcttggtgagaaaagaacaaccatccagaaattgagatgagaacttttgtgatctgtatgaatcacagcagatcatgggggaggaggattggcatgcagtgctgttgaaaattgggcttgttgttagatcagaacaacctccatgtatatggttagaacgaatcaattaatggaatcctagtatttctgcaagtttggtgatttttaaaaactggaatagaagcattaattcagtgcttagttctagtattagaaaacccctttgatgtaatgccttgtattaaccctttgagcattgtaagatatacaatgggggacaaaagcctttcagatcatttatttagacttagaccggtaaagtatactctatatccaaatgtctaattatgctgtttttttaaaggggggggtaggaagagaaagtgtttccacgccgaacacttgcattttatatacaactcttaatttttcttcaagagggcttgatatatttattcccaaatattcactgccatctaagtaagtgtactgtttacagaaaaaaaaaatcaacttttctagtatcacaccatagtctctagaaaaggaggacaaatacatgggcctggatagacctatgtcataactgatttctgcacattgaaggtacctagattgcctttaaaaggtataaagaaagggttaagtttcttttttttttgtcttttttttcccaaaatgaatcaaaagatctcatttatttagctttagaaagtacaagtgtaagtaaagccttaggaagaaaggagttcgagtggattaagagaatctgaactctttgggggcagttaggctatttggagttagatcgctcataaaatattgtttgcgaatttcacacagggcataattttatctatgctccaaaactttaatacgttgtcaaaaaattatatatagatagaatggagagcaaagcacttgattttaagctcatctgtcaggagatgctatgactactgcttctgatatctctaaatgtcagtctgcttacaccattgctgattttgttcaagggaatctcttcgtgcacttgattccctctgttccctgcgtgatcgaacatgaaagcagtgttgtctgcagatgtgcttgcgctgccctagctgggtgcaaataagagtgtaacctattctgatgtctggtgaaaggacatccatagcatagtgcaagtatgccgtaaacgttgc

SEQ ID NO: 16452 - DNA, 1291 bp, Homo sapiens
atttttctctgaggaaaaaatgagctgtacatttatcagttcagagtaaatgacagaattgcaagagattatgctaatatgtacataatttgtgtacataattattaaaccatgttaacaatgcaagcttccgttaaacattgaattttaactattatttgcataccaattcctctgtttaaagactactgattctgtatttgggaccactgcacagatgcattctgctgttaagtgggggctgttatagttagatactgaagcagaaaaaaaagacttgactttttttttttaagtgtacatgctacttatgctgagctggacatacaggaaaccattccatttggatgactttcttttattccaggtctttttcctaatagtagttcaatatgctgctattataaacgagaatttatagaatgcaaggaatgtagcaacctacataacgttatttccttcaaaactatttcctggtttctaaagtatgtggatttaaattgtaaacagaacctgaaggcagtgtaactggcacacctcactgttacttatccccaattctgtaggatttggataggtggctggatggaccattgccattgaagaatgtacatcagggatcatcgtacctcggctattacatggtgccttaaaacagaactgaagctaaggtttagtaaggtttattttgttcatgtgactaactcttcaatccatttgacaaagtgtgcctgtcattttcagattcctgaagtaaggacaggtgacatgttcttcaaaggaaatttagggaaaacaaaggaaaacaaaaagacaaaaatcagtttccctctttgagtgaccgtggatctattttttattcttagagctgaatattacttgattacaaatcagattgcttaagggtgtggaatagcaggctagttttaataccaacttgttaacataaaatcatatatgttttagaccattcttatttagttacaattttagaaagttaacaaagtaagcaggtacttatcgaagtgcatcttttcagtctaaatgtttgtctgtgtgtctaggtgctggtgagtccacatggacacatgagtgcccatggggcaggagtctgctataaagtcagaaggtgagatcctagagagttacacccagccccattttaatttgcatgaaaagccaaggttcttttaagcactcaaattatttaatgattaaaacacaagaaaggcacatctgttcatttaaatagttgtaaaaaactaatcagcaaaaataaatagataataaa

SEQ ID NO: 16453 - DNA, 1190 bp, Homo sapiens
ataaaatactactaatattaacgagaaaataagctacttttaaagtggtagttgaattccactgaatttcaggcttcagaagattaaagattacacctgcctctctgactgccctcggaactgtcaggggaagcagcagtacaaagagatcctgatctgacaaacagtatgaggcaatggcagagtcaggtatgttgtcagtgggttttaatctggaatattttcaggccagttcatgacactgttgactggccatgaatcttgaaagcttgagagctggagtgagaacacaggaaatgcaaaaacctttttccccaccatcctgtagctcagaaaatccccaacatctggctcacgtgtaaagccaggaaagatatgatttaccctggcagccggccttactgagagccttagctggttggctccatgtcacacaagaaaaacaccctataaggatttgctgaggattttattcacaagtggaaaatcttcatacacctcaaacgaaactaaagaaaatgttgtatgatacctcctgagggataaaagtgtttgaccttatcagaattggtcatggtagagattattagatgtcacactgtctgatcttttgttttccaccagccaaattaaaactggaaaagtactgagagagggatacctttacaaaggtagtgaagacactgttaattttttgtttttactcttacgatgaaaatttttaaaaaattgtcaaaagttgaaaaaacagttatgttgaataagtccatcatccagctttaatactgtttactccttaataatggaaataaatacagttgttcatattgagtttctgggaataactgtaccaactctatctcataaacaaccatctcctcctttacgctgaggatttgctttagtacctgtgtgcattcactgtttatgcatgaggaggaagggaaatgcagtttttttgaactcttctcagcagaacctttaacaaggaaacacatttctttattgccctcattcccaagagaagcaactatcattacacagacaagtcatttttattatttccttttatttgctttctttagttttctttcacatttcatataactgaaatgaatcactttttccccaaaaaattacttctggaaaacatatttttttacactaagcattagtctaggcactgtata

SEQ ID NO: 16454 - DNA, 1772 bp, Homo sapiens
cttggattttatcttagcccaagaatgtgtgtttagcacagaatgtaattaggggaaatacttaagggattgtcaatgcagtgttcttttagctcttaagcaatccgtatcctgctaaaatgtttatcttttttttttcttcctttctggctgctgttccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacggtgagtttccgaagcgcaaggggtgacctctcttgaaggcccggcttgctttgcgtacgtgtgttttttcctaactcggcccatggagtttgcatgcgtgggggtctaggtatccatgagatggggttccccttcagcttgaggaaggggaagatttctttcatggttagtggctctccattgctatatttccttctgcaaaggtacacgatccatcccagcaggtgatcagtctgccacactctgtaaaatcttggaaaggagatgccagccaggtaccaactttgaatttccttaatgtgtatggatgtgcaagagcagaaggacacagattgcacatcagcaagctttagttcttttccaaagcaaatatgcagtgactttttcttccctccaataaccgggctagaattgggatggagagaagagtggttttgatatttgaaaaggaactcaccacttagcaacttggctagtaaaagtgtttcggcatgca

SEQ ID NO: 16455 - DNA, 1209 bp, Homo sapiens
gtcagtccctctgttagaaaataagtattactgttggatttgcagaaaagtatatgaaaggcagtgaaagttcagtgaaaggaacgtgagtgagctgtggtatcaggcaatcccaaattccagtctcgatactgccacttgtgctaccaacgtgtacaccttgaataagttttttaatctttctaatcctcactttatgtaccaggaaaatcttacattcattcagcaagcatatattgggcacctgttgtgtaccagcactctgtcaggcatggagaatgtactgatgggtaagacactgtcctctcttcaagtggctcagagcctgctagactcacagagtggcaggcttatgtgaggatatatgtgaaatcacttagcagaaaatctggcacatagtagtggcttaatatatttatttttctttcctgtttgtcctctgagcctttcatgaacatggggaaataaaaaaaaattcccaagaatttagcaatttcactcagttacctcccacacaggatctcttagcaggaattgccataatttggaatttgaccaacgaaatacatacttctatggaatctgtactggactgagtcagcaaacaggagctcctgttgcagctttgctcttgggcaactcccttatcctctttggatgtcatttctgtcaatggtacaatgagggtttgggattaattaggcatgatctttatcccttcggatccaaatgaactgattttacttctgattctccacttgcgtcaatgttttgttcgtctgtctttcttatatccaccttctcctgaccctcacactcaaagagatttttggagttgttcgcaaacaggaacacacgtgactttttgtttttaaccttggtttagttgcttttatccccttccttcctctcatctctggttttgcagcaaatggaagaggaaagaggaggaagacttggctgtctctacatcttaccatctgccctcttaattacccttaggtgattcttgagtcctctgtttcatgctgagaacacatgagactgaagaccctctgttcacttatgccttcatcagagtaactgcttttatgtgtagccacggaatccttaagtgaaattatagaacaccgaaaatcataaatagtgccaactggaagggacgttagtggccacttgggaatacataaaactgaactcctggaagga

SEQ ID NO: 16456 - DNA, 1402 bp, Homo sapiens
tgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgtactttactaaataagttggggggtacaatttttaaaagtcttaactcttaaatacttgactttcggcaccatcagttaaatccttgactataatacaaatttgatatatacattacatttaccctcaaattattctcaaaactatattccttagaatttgattttaccctgctgactttaagagttataataatatcaaatgtgatgagctaatatagattttctttttaaataagaataacttcaagctcactctttcttaacatagtctgggatctctcagggagtaagttttaaaagaatactaatggcttgtaagaacaaacaggaataataatctgatttttaaatttgtagttattttactcatgttgccttttaatttttgttattttggtttattttttgatgtagccttttaaaaaaggagtcttaaaaatgattttttttttaaaggcaagagaaatcttgtagtgctaactgccttgagctgccaattacctatttctgagaatttggtgactcttattggtaatgatggcatttacaacatttggcatttcccctttttcagctcagttaccatagaatacttccaagctttactacttcctctgtaagtcatttcagttatgccaggatatttgatgattttgtttatgtagaattaggtaacaaagccaattatgctatccttattattgaaggattaatcttatgacttaacataagctttggttatatttgggtgtagtctttggctaagtacccattaaggctagtagcaaacacttggaaggtggctaactgggactgggaatacgtgtctcaacttgagaaaccaaatagtgcgaagggactcagggtggccagacctgtgaccttggcctcatttgtatcttgttttcgctgaggtgatcagacacttagtaccctagaaatggactggaattattgaatcttcttctgtaacatcacaatcttcctggtttt

SEQ ID NO: 16457 - DNA, 2572 bp, Homo sapiens
tgtaaatgtggaggtgtgtatatgtgtaggcgtgtatatgtggaggtgtgtatatgtggaggtgtatatgtgtaggcgtaggtgtacgcatgggctagaggacgggtattagcaagaggaaggccagaatctttggagggaatctgtgtggcttgaaaagcacccccaggattctgatctcactcttcaccatgttatccacaggaaactggagtaaataaaatagactttggctgctggtctagtgacaagctagacaaatctgcctgggaagaaatgaagacagtcaataggaaacccaataaaaccaacactttttattcccctttctgttaatattcagaagagtggaatagaggagaacataaatgttggcctgggcaaaaaggaaagatactcaagtattagaaagtagcttttgcaaaagagtaagtagaaaaaaaaggctgatgggtgttctggtatcttataggtcctgtttggaaatgtactaccaacttggtgatttgggctaagttacattacaaagggatgattttattagtaaaataagaaaatttgagctttggaaaggattaaacaaactataatatgtaaagcatgtagcacagcctttgacacacagtgcatgttcaataaataaaataaatgataggtgctgttatttttttaagcacccatttttgtaagccagagagcacaactgaaaccaaaatgtacattttccaatgcccagccaagtgcctttctctcctgattacacaaatctatacttaccaagactcctatatctacaatatcattatttacagaaaggctttgaaagagcttattaggaagactcagacctgtgtgtgtttgttttgtttttgtttcatctttaggaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaatcataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactt

SEQ ID NO: 16458 - DNA, 1371 bp, Homo sapiens
ttgggacacccatagtcccaggtagtcaggaggctgaggtggaggattgcttgagcccaggagcttgaggccagtttgggcaacatagtgagaccccatctcttataaaaaaaagagtcatcaccatatttctgtccattttctgctaggtctgaactaaataacttatgtgtcacgtacgaacttctaacctttccccccccagtttaatttatcttgctgtattgcgtgtatctctgcaaactatctaaatcttctttggaaactggctggctgaaaggaagtactatttaatcagattcgatgagaaggtcttaacttcagccctctaggtctgggagattaaaaccttggattctaggtggtagaggataatttttttttgaatgaatttctttttatttatttatttatttttttcctttttaggatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccaatgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcgtagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgtttttatattccaggtgtgctgtacattcttattttattttcacaatagctctgtgatgtaagtgctatctccatgagaaaattcataaagggtgttttgttcctttgaaatgtataatgtaaagacattaaatctcctcatttaagga

SEQ ID NO: 16459 - DNA, 1209 bp, Homo sapiens
tatttaactcagtaatatctactttaatttaggtaatttttatgtagaagatataatttgaagatatatttaatgaaataggttgatgttatatgtactctgtaattgggaacccagtgtaaatcagtttccatttgcaaatgaacttttattaaaattgtatcgcaaaatgaatgaaaattaaaggaggaatttatgccatttatttatttattaatcattttagagactgggtcttggtctgttacccagactagggtgcagtggtgtgatcatagctgaagagatcctcctacctcagccccccaagtagctgggactgcaggtatgtgccaccatgcctggataatttttaaattttttgtggagatgagatcttgccatgttgcccaggctggtctcaaactcctgggctcaagtgatcttcatgccttggcctcccaaagttctgggattacaggcatgagccactgagcctggccaatttgtatcttgtaaatgcatatgttctgaaaattatgattaaaatataatcatagattaaaacatgataatgaaacttacgatgagatatttccttcaaatttttggttttagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcaggtaattttcttttgcaaatccttacacataagtgtgagtagagattttatataattcgtatatattttctgtgtttacccatgccttttgattttgtaatactagttaagtactccttatctaaaatgcttggaatcagaaatgcttcagattttggatatttccagattttggaatattggcattgaacttaccagttgagcacccctaatccaaaatgctctaatgagcatttcctttgaacatcatgttgacgttcaaaaagttctggattttggaacatttcgtatttcagatatttgcaagagggatagtcaacctataataaaaaatcatatgggtaagttttatatcttgggagtaaaacacactttgtaaggtgaaattatttaaagagttgtactacaggaaatatcataggtattaaatatctattatttgatttcatttattctgagaaggctag

SEQ ID NO: 16460 - DNA, 1123 bp, Homo sapiens
tagccatatttcaagtgtatagtcaccacatacagctcatagctactgtttacagatagcacagatatagaacatttccatcattattcaaagttttattggacaagtgccagagcattgttacctctacacttaatggctctagattgtcatactgttattagttgggtttattcattttatggtttctctacctctttttctttctttctgctatcacttctgtttccatcttctaatttgctgtttcaatatttgtagtttttaactagttttatcagttatcaagtttgtgactgtgagtgcccatagtctttcatttctttcaggatttctgattctagattgaaatatacatagataaagttgcagataaatggagatgttttgtaaatggtttcatgatcatttttgcatgagtattctctaaagcagttttaatattcatacacattgctttcccagtatgctctcttaaaaattaattgattctacctacagtttgcagtctgtgttggaagatctcctggttgctacttctgatggacttcttcatcttattcactgggaaggaatgacaaatggaaggaaagccattaatctttgcacagtacccttttcagtagacctgcagtcatctagaggtagctatactttctacatgaggttgaaccagttgtttaatgtttgatgtctagttaggtatcttctatggatgaacacttctttggaattacttatgcaaggggagaggtgggcagagtatgagaggcggggtgagagaggcatttaataggaaaggacagtttaattatttagggttgttaggtcattatttttacccttttaaacttacaggtttttctggcaaaaagtgagagagtaatttattatattcttaatcctatttcatgtgcttatttttttcatcagtaggttcattcctgggcttcacagacgtacacatcagagacatggaatactgtgccacacttgatgggtttgctgttgtatttaatgatggtaaagttggatttattacaccagtgtcaagtagatttactgcagaggtatgacttatttactttgaagggttttttgttattgtgtacttattttattc

SEQ ID NO: 16461 - DNA, 1208 bp, Homo sapiens
ttaagaaaaaaaaagttggtattcttttcatatgtctgcatgactcacactgagaaatttaatttcactttgcctctctatccttagtttctttgatgtgctctccttccctcttttcattgggcttttcaaatatagcatagaggtttgctgcctttctttctgtcagccacccatcacctgcttcctggtctgacttcttctgtcccccttttcctgttccctgtattcattctacaaatgtgtcttaagagccttctgtgttccgagggttgtggtgtaacacggaggagaagcgttgatactttatcttcattgtcaatcagaattagatcttggatctcttatctccttgtcagctttatcagtacctctgcgtaataaggatgtgaaatcctccagtaaagattattctgtagctttcttgtgtttccacttacagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactggtaatgtagacttcatgtcacttgtacaaggagaattgtattttactccgtgtatttacacattttgctattagttgatattcaaggaattattttcattccaaacttaggaatggataaaagccaactttttgtacatgagttggaatgcccactgtttgaccaaagatgtaaataaagtagaacctatgtctctaagtcttgtgaccttgaagtctaattcaaaaatctaatcatacttggattataaagaagttgagaactgcctgaatataaaagctaccatgcttatgttattgtgggaaggagttctggaatcagatagacatggacctcaaagtaagctgacagaactcattccaggggaacagtaaggccaccttctaaactaggagaggacaaactgaaagtgtatattttggtgaaataaaaatttaaagttttttaattcaggactttttatgaagactgttctaatt

SEQ ID NO: 16462 - DNA, 1889 bp, Homo sapiens
ccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgagggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccatt

SEQ ID NO: 16463 - DNA, 1344 bp, Homo sapiens
cccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaagctttctttttatcattaggaaatgtgaaacgttggacaaattttgagttttaacaaggacaaaaagttgaaagaaaaggcacagttaacaaaaaagggtggctagatttatcttgggtgatggaggaaatgagagaggaatgctcttgaaaggtggtctgtggatctgtctgaatagaaagagcacagtaagtatgcattgccggagaaaacgtccttgaagctgcttgtctcatgtgtatgatgtgctttttaaatcatgcccctcgttgcctgcctaatctgtgactccctaaaaactaactgggcccatgtagatggggctgcaaccagagctgaataacatgttaggctcacacatgcatcagcactgcacactggaatcattgctcttcctggactttgtagaaatcagtctcaagtgcttcaagagtctggctcctgctacttttatctgtcaggtagcacataaggtttgcagggtttatattttgtatagaatcacagttgtggagaa

SEQ ID NO: 16464 - DNA, 1182 bp, Homo sapiens
agctcatagcaggtattcaataaataatagccattatttttctttatctgttaaatggagacagtaatagcacagattaagttgctgagttatgaagatctgattagattatgcatgtgaaagcaataggccgggcctcctctgcgtaatcttatttctaattttaagagccaggaacccacttttttggagcctgatgttctaatattccttccttacgaaagccaggtcattgcttttttcatctgcctgatgcactgtaagagccttgtgtgttctttcaaaagcgatctctcatttttctcgttttgggtttttaggtgtctttacatttggcaatctccgtcctacagagggctggaaaagccctgcgggagacggcatatccaccacccgctgctgggtcggccctgcagctgtgtgcacccgagaactgccaaagaagctgggtcttggcgcggcgggacgggccaatcagaagaagtttggccctctgcagtttccgtccgctcactaggaggcgctgcggcagcgacggcggcgtcggcggcggccggggctgtcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccaggtaccggccgctccctcctggcacggcccgcgcgtccgtttgcggctcctgcgcaggctccggggcaccgcacctgtgtgcacccgcccctgccggaccgctgggactcgctgacccctcccaggctgcacgtggggtggggtgaccttgcttgtccttcttctggggtctgaattgccgggacttggggcttgcctgtccccggttaagctcgtggtgcagattggggttgccaggta

SEQ ID NO: 16465 - DNA, 1144 bp, Homo sapiens
tgattcgcctgcctcggcctcccaaattgctgagattgcaggcatgagccactgcacccggctgtttataattttttcaaagtgtttatgtatcattttacattttctttttccaaatgtttctgtattattgtacattttctcgtaccaataatagatagtatgaaatacattgcaaacaataaactttgttttctattaaagagatagtgctttagtcaatattttaaatgcttcagtctcagatttttttttttaatgcagggaagagactgtcactctgattttatgacataaggagtatgagaaattgtgtagggaggataaaaagttagaacaaagctaagtaagtaaggtttaaatacttttatgtatttagcaaaagggattcttaagttgctggctaagggggtttattgcttatccagaagatttgaccttgtgaattgacttattcttctccaaggcacttgagagaaaagacaacgatagcagttacatctagaggctattatggattggaggatgagaagggaactgcatgtacctcaacaaggcgtcggtcaacaccgcgaagtttggcaggcttgacaagtggagtttttgaatctataatggttcaagttttgagacaggaagaacagctgagagcaaaagaagaaaaaaggtaaatgttaagaaaaaaattcataatttcagctgcataatttttatgtgcccatatcagatttctgggcccattttagtagtgttctaaaatgcattgttacaaaagtatgaattcataatgaaatatcgcaataaaatttgtttaaaatgtaattttaaaatttaaaaccacttatcttgaagctatacaaaaataatttctacagaatatttcagagtgctttctagatttctagtagtattcattctcaagtgaattataagttttaaattagaggaattttctataggtttgtagttttagaacagaatcacagacctttaaaatcaggagaatctccagagattatgtagttcaagcatgacataaattcacctctgcctgttcctccattggaattaatatcctggataactgtgcttactctgggctgatcaggaaaaagtgtgctcaattaatggtagcttctagggt

SEQ ID NO: 16466 - DNA, 1457 bp, Homo sapiens
agatatcaacagcacatagggatgcttaacaggggtggtgatcagggacacgcctcctgggaaatgcctcttttttttaaatggtaatgtagggttggattttaggttctcagaatatttgctgggctgatggtgtcttaggttgtgggactagcattgccacctcctttgccctaagagaaacctcccagaacatctcacagcatttccatcttttgtcctttgcagcccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaagaatgcctttctcttggtgtactttatagttttaccaccgttacaacctagattcagtgggagctgaagggcaatgagaacacccaacccaatagccattgttacatcatcagttttgccttcgactggctgaagaaacagttgtcttggtcaacagtgaaaaccactttgaccctttttgttggaactgagttagagtgcatgtaactgtactccagctatggaaggtcaatcaaatagcaatttatcttttctcatttaagtccagaggtaataagccaagcactggtgctccttcagttttcccgctctgccctcctttgcataaaattttcatccgcatggtctcaagaaggctgttgcatttccaggcgtctgacatacccattctagttaggattaaaagggaagagcaaaggccaggcgcggtggctcatgcctgtaatcccagcactttgggaggctgaggcgggaggatcacctgaggtcaggagttggagaccagcctggccaacatggtgaaaccccatctcta

SEQ ID NO: 16467 - DNA, 1127 bp, Homo sapiens
gttcaagaggaccagcccgttcctcacccatcaagtgttcaacaggtttgtgtgtcttgtgtgacttctgcgttttgtgctttggtaatcagctagggagttaggcagagtgctgctgctgatttcgcctgctgtggcctggttattctggctcagccgtggctcccaagtatttcatcctcataacgatcccgttcctgacttgggaaaagcacactttgtttcctggtggctctgctcccttggcagtcaggaagcagggatgaataattgccaggctgaagttcactcccaagagccctatatcctcttcttcccaaccttcaactcatacccacagtcagcttcttgtccaagacatcctctgaggtttgtgggggtctgtgcccttctctctgagtgtagttgacatattgtccgtggccaaaattgatctgcattttgaaagtagatttcggtgtgtcttatatgtcaggaggatgtgcatggactcatatctacttttggggcccctaattctgtgttttgtgttcacagctaccactctgaaacaaacattgtccggtacatgaagaaactggaaaataaagacatttcccttgttcacagcatgattccactggtagttatttgtggccttttttctcatttccaagctaccccaatcccacgtctcttggtcctacctaatatgctccaagagcaacaaaggggtggccatgctgggagaatggagggttgattgatggactatagaaaatcactaatgtgatacattttggatgttcttcttaaagggatcctgcaccatgaaactgaacagttcgtctgaactcgcagtaagtagctcacttctgtaagtggatactcagcaaggggcagtgttctagcttccacctaagcccagaactagtgaaatctactgggactgtgattctgtgattgaagaactattttaataattctttaccttgctattcaccaatcttgggagtaaccctgtatttctcacgacttcatcatttaaatgtatgggtaaacttattattttttaataaaattaattaaatgtatatggtatttatgcctttctatcctatccctcccccacccccacccccttttaa

SEQ ID NO: 16468 - DNA, 1241 bp, Homo sapiens
agggatgggagagagatagcagaagatatattttgctgttggtttcttgatgtgatatgtgatggtgaatattacctctaaactaatgtgcaaaaaaatcccaagaaaacccaaatctcaaaaccccaaaaacaaaaaggtgtgccaaggagggagagcacatgccggatcatctactttgaatcagtaattttttgctgacagccaagttgggagtgggtctgtaactttcatttccatttggcatcaggaagctatttggtataaatttctaccagatagttgtatggaaccacattatgctggtagtaatctttgaccaataataatggacatatgtatgtggctcttgaataagagttgttttatttttcagttttcagttagttagaatatacaatgtaataattttggtggatagtggtttgattagtaaatgctatctttcatggtttagtaagatttgatttctctctctttttttctctctcattccagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggcaagttacttgtttaatattcatttactttggagttttgaaatttgggcatcaggcacatattgaagaggattttgttctttgatttggtggattcagatttatgtgagctgtaaggaagtttttgactgtaatagttaattgtcttctattctgtctgggattgtgcttggaaaccataaaccccatggtaactcgtacagtcatgcactgtataacaatgtttagatcaatgatggaccacagatacaacggtcatcctgagtttataatgcaattgaaaaattctttttccatgtttagatatgtttagctaaatgaatactttgtagctaaatactttgtgttaaaattgcctacaatatttagttcagtacaggtttgtagcctagaagcaataagctatgccatatagcctaggtctgtagtagatccactatctagatttgtgtaagtccactccatgatgttcacacaatggcgaaattgcctaacaacatatttctcagaaactatcactgttattaagtgatgcatgactgtatatgt

SEQ ID NO: 16469 - DNA, 1261 bp, Homo sapiens
actgttgaatgaaagggttgttgtatgtttaacttcctcatttaaaagcctcctcaaaacacttctcccattcaggctgttcaggcaggttctcagacagttgatgggtgatggctgggaagttcattcaggagattagtagcaattagtttcagattaatcagaaaagaaacagaaaggtgggggaactactctgtctgctgtatgccgaggattgggatgagtgcttcaggaatgcatacttatctttcctttttttcccctgtatttttagctatagatccagcatcccacgtatttatctttcctaacttccctaaatattttctccatttatcagataatagattgaatccacatttgtttcaaattgaaatttattcctaaagttgagtaattttacaggttacaaaaacaacttatggtaaatctgtttgtaaagaagatcaacctttggtgatgtatcctttaatttttaagaattctaactctgactctgagttttagtacaagggctttttggcagaagaggtccatacttgcataagtcaaacagtaagaacactagaacttacacattaaaaaacctatttgatattttctcttaatcgacacagtgccacttacatttattgtttctttttaggttttttcccaagcagctcccaagggtgtgatgcatttcttcgccacaagatgacattgatttctccatcagtattgaagaaatatggtattccctttgacaaggtatgttagtattcatcttacacaaattaattttgtttgtgtaggatttgtatttaagaagtaatgtatctttaacttccagtagaatttttaggatgtgggtagagaaattcaaatttatgttttatagcatatcaattatttatctaaatcctaattagaaattaattttatttcaaatatatttactagagatttcatgttgctatagttcacttataattgtactgaaaataaaatgtagcacattctataaaataagaggaagcacttctatattaaaatcttttttatgagtaacataatttatgtatatgtgatctattttctaaaaatttcagagcaattattagcaatgggttgcttagaatcaatgattatggtagcactatgttgcttgtaaacacatttagacataatacaatcgagatttcattatggataaaattgcctgatgatttaataatctgatattgcttctgcgagttttctgaagattaggttctataaa

SEQ ID NO: 16470 - DNA, 1139 bp, Homo sapiens
taaagattagcattaattcttttggaaaacttttgctacttaaacaagtttgcttcatgacatttgtattattttaaaaggttgtgtgctatacccagttcataccttttattaattgaactaatcttttgccacatattgattagcttaagtactttaagcacatacatgcatattccagcatcaaatgaaataagaaacccacatttcagtattttgcagatcaagtgtagaaaaatatgtgcacgttaataggatagagtcgtgggcctttatcagctcttcatggcacaatgttgttgggcagctgtggtactgagtctgtccaggtatcattcaggaggtttacagttcagaatctgtttgtgatggatttaggcttttggctttcttgctcatctgtgtatttcccatctgtgagaactggcatcaccaagttgaagtatgtaagtttagggaacttttgtttatgtttaatgtctcctttcctgtaggtgggcccatgtcatgtgcgccgttgcggtcccagaagttcgattcactaatgtcccagaaaggacacaaatagatgtaggcagaatacctttacagaggttaaaattggtgagtggcaaagcttcttttttacctcataaattagtgttaatttcaagttctgaatttttccattaatgcacacattcccaaggtatattttctcctagctttcttttatttttctacccttattttcctttagcctaaatttatttattcttacaaattcttttcctgttatattgtaagtttgcatataaccttcctcaatttctgtctgaaatgaggaaaaagatagtaatacatttcctgaattaatgtgaactttcaaactataggttatctggtaagatttgtcagtactggagctgagccatctaactctatttaaattgtttagatttttctctcttgactctctttggttggtcttaacctagcaaaatgtatctaacctaatttcattatctcttcaccaagaagagacacacagagaaataaagaagcttttatttttacgaagatattttctcactcttgaataggtacaagtcacttaatatgccaaactctctggcttgttcagaaactgtgtaaaaatc

SEQ ID NO: 16471 - DNA, 1187 bp, Homo sapiens
cttcggctcacccagacacacgctgactgggggagaaactgttcaaaagagccagcagtccacctcagtgattgtgtggggttcttttccactcacttcagaagcagccccgttaccttttattgtctcacagaataaccatagcaacggtgcataattagctagagctcctggtaaatcggttttattattgtatttgagaggccgacttttgctgtttctgcacagtggcaacactttcatagatgttttattttcttctttgataactttagcacttacacaagtgaaagattactcagaggaagtattttgccaagaatgaatgaaacaaaagtgttttctcctaatggcagagggaacccaaccagcccataatgatttagttttcttctctagtgaaactaggtggtatgtgggggaagccgtggaggtggcctgttaccctgagtaactgtcccatgaactggctggaaacatgaacagctttacgcttcggtacattttttgttttcaggcttccttgtggctgttttcttgtttttctcttctttactatggaccgtgtgttttcaagtcctaaagtgtctttcacctctgcctctgccagcagccaggggaagcagtctcagcacagtgaaatgtgctgtgtgttgatgtcatcagaagtcatccacctcagtgaaaacagctgccagtgcattttaggaggcaagatagtagggaattgggaagcaaaaatagtgcctaccatagactttaggctttatctgattatcacagaaaaagccacatgccctcactcagcaaacacttactgaacagcagccaaatactagccacattgtttgctgtggggaacacatgtaaaattgggtacacagtccctaatatcctcacctttatggggttcccctgatggggagaaacttacttgccccttacctctaccactgccctcctcttactgagtggatgtgtcagggccacaggagtcccaaagaaggacccttaagcttgccgagggcagagacagtagaatagaataactttcacagaaatgaaacagtgtgtccaaagacagagaagcatggggccctgagccaggcaagtatgaccaggccctgcaactgatgccgtctgagcagagcacggggcaggcttctggccaggttatgtaggtctag

SEQ ID NO: 16472 - DNA, 1549 bp, Homo sapiens
ccttttagcctgagctggtgacctgggcatctgcaccctaaccccagctgaccgagtcagatctttgtccagtgttctgaagatcaaatgccgtgcccttttgcaatataacaccagctgcttttagtccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttagggccctgtcaggaaacacacggggacctctctctctagctccagcaggtggcacctcggtacccagcgggtagggcgataatttatatattttccacagtcagggaaggactctcacttatttgtttcaaattgcagtttttataaaacatttttaaaacacaaatggcatgtatgctaatgagatttacccgtgtgctatctgtatttcccttgtacagaacttttacatttttgaatattcctattacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattccgagtagatatttataaaatatatgtttctttcattatgtgtttgtaaaattagagtttaaataaatatgctttgatgcatagttttgaactaatgtaacatgatttttcttttttaaaacagcctgaaaatgtactagtgtttaaaaataaagatttccattttctccagtcctgtctctgacttgcttatttgtctgggtttaaaccagtagaaaaacaagtttattggagagctggctatcaggacatactgcggcccaggtttttcagaccctccttctgtcgctgactttttccatggttgtggcacatgcatggcgatatttttggagacaaagtcccctgcctgcctacttcagtaccaatggaagtgttttcttcaacttcttctaggccctgaatacatctcagacccttgagtctggatcacttttcgttccaggattcctggtccgcagctgtcattagtaggaattagaggtcctccagtccct

SEQ ID NO: 16473 - DNA, 1176 bp, Homo sapiens
agcacatgattatgcacatataaaacccaactccttgattcacaggcctctggataggagatatgacatgcccaaggtctcgcagttcatgtgaggcaggaaacttaagagagccagacttctttaaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagtgagaatcaaggcacagcacttgggcgggttgggtatctgcggggtagaggaaggaaacggagcagccacgtgggcggggaggcggggaggcggggtgctgccgctggtcaggtggtgggggcacctcaaacaaggtgggagaggaagttgttggaacgcctttctttttttttttttaattttaagttagtatttcttgagaacccttattagactcagcccttttaattctcagaatagctgttagaagtaggtatgattatagtatttactgtggagcaaaccgaggcaacgaggagtattgtgttcatggtcaggaaatgacagtcacttgatcccaggtatatcagatctcaaagcccatactttttctccaggtcctggagaaagcctgagcgagggcccttgaccttaatttaagaaatttgccttgaatcccagat

SEQ ID NO: 16474 - DNA, 1143 bp, Homo sapiens
ctataggaagagcaagtggaaacactgtagagtatctaaaggacaataagcccaactacaaacttgaccgcatcatcaaggaatggtaccctacgttcactgatgccctgcgagacctggacaacgccctctccatgtgcttcctcttttccaccttcccacggactggcaagggccatgtgcagaccattcaccatggagttcatgcactacatcatcgctgctagtgccctgccacaaggtcttcctgtccatcaaaggcatttactaccaggtcaaggtcctgggacagcccatcacgtgaatcaccacttatgccttctcccatgaccacccaacagacatggactacagggtcatggccaccttcaccgagttctacagcaccctgctgggcttcatcaacttccacctctaccagtggctcaacctccactacccactgaagctcgagggtcaggcccaagaagaggcaaaggccagtgagggcacccatgcattggactctgagagctccatggagaaaatggctgccctcactgccagcctggcccgcgtggtggtgcctgccacagaggaggagcccgaggtggatgagtttcctgccaatggggagatgtcagcacaggaggaagaacgcaggaaggagctggaggggcaggagaagcacaagaagttttctgagggcctaaagttcttcctgaaccaaggggtgccccgtgaagccctggccttcgtcatcagtttttggggggaagtgtcctgggacaagtctttgtgcatcggggccacctatgacatcacggactcccgcatcacccacaagattgtcaactggcctgggcagcagacctccatcattggcaggtgctacatgcagccccagtgggtgattgactcggtgaacgctaggcttctcctcctcatggcagagtacttccctggggtgcagctgcccccacacctttcaccttttgtgaccaagaaggaaggagattacatcccacctgaaaaactgaggctgctggctctgcagcagggagaggacccaggaatcctgaatgcacccgaagaagaggagaaagaggacgacaacaatgaaaatgatggtgatgaagggggagaaaatgaagaggaggagga

SEQ ID NO: 16475 - DNA, 1220 bp, Homo sapiens
aaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacagactctggcctcatgttttatttttctcctcatcgtctccttgctgttctgcctacattaatgttgggtcagtagtgtcccagaaattgatcttggcccttaactttgggggttttgtagcactgatttaattattagcatctgggatagttaatatttcagttcaatatttaaccgtatatctgtgtatatctatataatccttccttgcagttcctaataaatacagtcatcccaagctttctaaacaatgacagtaaaaaaaaaaaaaaagaaagtgcagttatagaatcgcagacctcactctctgagaaaggcctttgagcaatacgttgaagacgatgtgtgccatgatgactggactgtggtctctgtgagagaaaaaccacagggcatcaaacactga

SEQ ID NO: 16476 - DNA, 1214 bp, Homo sapiens
gagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagtt

SEQ ID NO: 16477 - DNA, 1155 bp, Homo sapiens
aagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtg

SEQ ID NO: 16478 - DNA, 1102 bp, Homo sapiens
gagactataacaatgtaaggaatagtcaccatatatacttactacctagtggccaactatttaaaggtgcatcagctttcttcctggatcagttacaagtaattgatttttgtatgtgtgcttatgggaagtactttttttcaaaaacattcctatcagacttgaggccattttcacaggtaaaataccgagctgattcattctacatgatacaggcttctccttcatgatagtaagatttgatttcctttttagcaaaacttttaagaaagacattttccatcccatatcattaagaacatctgcttaaattccatcattaaaagctgtcactttttcctggcggactttcagtctgctttacatttagaatcatataccatcattgattattttatattagacaactactatctggtgaaaaagtacgtctaggaacagggcccttctatttatccaatccttagtacctccacaggacagttactagagcatgtaagtgtgagacacccacactgaagtatgagatctgctttactggatagattttttagggggaataaactagttgatttgaagtcaattattatttcttttctatcacttggtgttcactcagacaaaagagaagagaaatgaagacactttttttttttggttgcaaatcccacttctctgggtttcttatacatggacagggtgttcgttctgatagttcacaatttttatctttgtttttgttcttccttaatcagcctacacagcctcaggcacatctcaagccaatcgatatgtgggactaagcccaagagacccatccttcctacatcagcaacaggtgggcaagtttcacccaggtgtgacggtgtagccacgctttcgcttccgtgcttctccatgttgcctctcagatccggactcagaagggggctcccggggcttctgagaccaaaactgatcatttcatttcccagaattttttctcattgatcctttgtttctcacctctttgagtagagtttctcaaattggctcatgaccttttccatctctgtagcatatattgataacatccatgagtaatagtgtttcagccaaagtg

SEQ ID NO: 16479 - DNA, 1037 bp, Homo sapiens
tttaaatgcatgtggctgaatgcagtaatttttcaagttattgagtagtagagaattcaccactattcactgtctcccagagatgaacatataaaagaaaaaaaattctacttcatatatgtaagaataaagcaactaaatgatacaaaagtaaaaacttccaccagaatcagagatattccgacaagtgaattgtgagtctaacacgggaggacaaagctaggctcttgcaaggacagagcacacgtggatcatgctgtatgagctcactttgtgtccctggaattagtgtttttttgtgtgtgatctaactggcaagtttaatgaatagccaaaatctatgttattcttgaggctcctaaaattatgtgtgaaccccaagttctgtctagtattatatccctaaaatgcttttaatagtggtatgttacaagtggcataagaagatcctgtttttaaatttgtcaggcattttattattcagtacataatatgtatagatctgagtgctgttttccttgcattgtctattatttttaccttgtctttcccctaagagaatttgaagaaaatcttcaccaatatttctagtgttgatggtaattaggaaaatagtagttgagagatgtaagaatagtttgagaagagtgagtaaaatgggtgaaatgacaagtgggaaccatgtagctgagatgtatttgtttagatgaaaagtctacactggttcttaatgtgaaaatcaaaccatgtatctaccttaagaacaatgttgttgtttttaatttattgtagcgatttagtttttttcacgtaatatttctattttctttgcagattgtttttaatttaaattgtggaatttttacttctcaaaatgtattaagtactgtattttttgaaatcttatttttaaataaatattttttaaaaacgtaggactgtttttatcctcttacctttcttacttaggaaaattaacccaaattctagatttcagcactaccaatgtaataggtcacttttaaaaattttataca

SEQ ID NO: 16480 - DNA, 1831 bp, Homo sapiens
gaaatcatcctctgaatttattataaatcacagatttcattgtgctctatatttagtcattctcagttgaattctagaatattccacagtacagtataagaaagtattagaaccaacttgcttgaactattttgaaccagtgttgtaattctatatgttaatcagtatttagcatttctgctccttttgagatgatgatggtttaacttcaggaaagtgacttttctgacttcttttattatcattgtgcaatttttagcaacaaaactcactatatctttgtcagttcttcagatgttacaatactgcctgctaatttgaaacagaaataacaatggtattttaaaaagtcattgatattactgatactttccattatcattatattttttactattattatgttctttttgccttgtccaccctagagaataggtacaaatgagtagtgagtatccacaaacttactaagatggagagaaggctagatggtgcatgaataatcagcatctcagcaacagagttgactggagccagtttctgacatcagagaatctctttgctgtaatcattttagccttatctcttatttataccatttttatgggaagagttgttagtgcatataagcatttagtttgaattatttaacttaaagaatttatattgcggtttctcttcagttggtcagatgccttttataaatattttagttttaaatataattgtgtagagtatgatcatgtgaagtgttaaaaataatgtggaaaactcagctatttaatgcagaggagaaatgaataggttgaccaaagtttgaaaaaactggcaccttttctggaaatctcttattgcaaagaaaagatactgagtgtatagaaaattttgtcaccagaggaaaaataaacaatatataagggtggctttcactttaacatttgggatattttggagttcttgatacctcgaaggtctccatttctattggtattttgaatatctgtaacatgtaatgtcgttcttataacagttcaacactgatttttttggtatcgatagctttatatataaacaaagatgcggacaaaatagcttaacagaagttgtgggcttttttgtggctttgcctgcctgtttgaccaaatacagggtttaattgtttgcaggctgttaactaaagggaaagcttacctgcgtattgcaagctatatattcttgccagtatacattggatgatattttaacctactggtgcctgaagttcgtgttttataacctcaacaactataaaacatcctggtgctattcactttagcattgagtgacatttttaattcctgtaccaaagagttaattttctttttggttgactgagttttcttctcacatcgttgtgtatttataaagtagaatttaatgttactaagaacagtttgattaacagatcttattttttgcatgctgctctggcaatttaatggattttaaatgtttctcatttggatttttttttaggtaggcatgtatggattttaattttgtattttaatatagcttggctactttaaaaggtagtttgataggctgaaattacaaaagataattgaagcacttttcacaagttgttttatttctgcaacaatgaataaaaaggtaagaactctaatttatataaatgaactatatagcttattgggcactttagtgaatactgaaacaaaatactaagatgaagagttaaggttcgttctcattacaaatcgagttcagcgtgtgtgtgtgtgtgtgtgtgtgtgtgtgtgtgtgtgtaatctttagtggctttaaagaa

SEQ ID NO: 16481 - DNA, 1161 bp, Homo sapiens
ttgtgcaagctaatttggccacatttggcctggtgacagaactgttcataaggaagtaatatatagataaggtaggtagatatcagttgaatgccttatattgtatacattcctttcaaataaagaccttgagaaaacagcagagccaagtgaagatcacctaaagaactttgtggctaatttatacttcatgtagtagcagtgggtactgggcagggtctctttcccactctgatgatttgtgctcttatttttcctagatttacctcatctagggcatattcttttccctcttcctctttacctttcctggtcctgatccctctgtactcagttcccctaaattattggactacaaactaatatactagaaaagcatacacttattttatttgaatgcagaaatgctatctatcagtatatatacataagaatgtatattacagtatatctatatatacttaacactgtaactttcagtattccccagttagcgtacctaactctcctgtgggttttgttaattcttattagactactagagaaaaaccaactggcagtttgctaagcatatctactggtgttgtttctgcgccctcttttggctaattgatgtaattatactggctctaaagatttactgccccataagtaaatagtatagccacattctgaacatatcaaaagtacaaacttaggaggagtgtatgtacaaaaatgtaaaattttatgaaaatgaacatgtttttatgatgttatttctagttcataagaatgtgatgactgctttgcttcatttatgtacgttcccattatattcttgctgtcaatcaatcacaaatttatatcagattaggataaactaagccattttatgtattttattttaaaccttattttggcagagtaattccttagaattggaaaagctgttactttgaaattaccaatttattacaaaacatagaaatgtattgtagctacaaagacaaccaagcattttctgtgttttaatgaatatctaaaaaactacatttagtttattttactcagttttgaaatgatttttttactggctctattgccttaaaataactaagagattaatgattctttgtataattttccttttctttgttcttttttttacatttcgcagag

SEQ ID NO: 16482 - DNA, 1149 bp, Homo sapiens
aaaattttcacttttaaacagtaaccaaatctaaatttaattattcaggttttacaaaagttgatacaccttcttatagtataggtaaattttctttttcaaatccaatttaaaataacctttccttttaaatgtgctgcaacgtttttaaaaatgcagcagcataggagtgaacaacagcaacacaaaacgggcattggtttcttaggagtggcttgcttacgttttcttcttttttcttcaccaaaaccaacatgaaagtaccactgaagtaaaacaccaactacctaccttactataaaggaaatgttaaaatttttttcacaataattttttcaattttcactattactgttgtaattattgattgtgattaaaatatttgctcccaggagaactcctgaccagtgggcatgtattcctattttatcctaagattttaatgagcaaaaaggggagagaatttgcaataacttcacaattaccttttctagtgcagttatattagaatgcatatgtttttaaaatgctagtataactagatagtatataatgtacagtataaagaggaatattgtgcttttgaaaagagtatactttttacttttatttatgtactagtagatgtaaaatttcacattgaaggtttatatatattggccaactcatatagaaattttatttataggaagctactactaaaaaaagtcactaactttgtgtacctataatccctaaattaaaattaaattttaattggctggctgtaatttgcattgagagaccttttactagtagctagtgttaggaagtgaacctaaaataagaaaatataatgatctgtgtttatcattagccttgtacaaatgtaaattactaatagtgatgttcttttgcaaggcatagaacatttgtatgaaaagacatttagtatgctttgaaaaaaactcagcttttagtttttttccattagaatactgcaaaacccatatatctttttaaaaaatttatgtactcacagtctttcccttgaagagaagattgaaaaagtctactgttcataaaccatgctaacattttccttttagctagttttgaaagtaaggaacaatacctgggaaataattaaacagaaggttaccattgtca

SEQ ID NO: 16483 - DNA, 1134 bp, Homo sapiens
ttctcttcattttgtccacgttaatgatttctagatatcttggtcacttgaactttagtaatatgaatcatgctgtgtattcaaactttttagcagagaaataataaaattccttttgtaaaccaaagattgtacaaccatctgtgttttgttttgttttgggtttttcttttctttctttctttttttttttttttttccccaaaataggttcaaaaaacaaacaaggctaacttgcacctaagattgaggagttttgatgcagtagagtagtaaactcctgtattttccagcttgctattgtaaattaaaatacctatttttgaaattttaaaatatttatacattgatttcaatagaagtataaaagagggagaggtagttcttttaagataataaggaagatgtgttatggctcaattcttgattattattgcgactgtaagcaatgtaagcaactctgaatggtttttaagactttctttttctttttaggacctctttgtttttagacatgaattggccataatgagactagcagcctttatgggcattactatgttagttggaataactggactcttttacactcaactaattggcatcatcacagtaagtatatttttaatgtaaagtaacatttatgaatatattacctaattatgaatgtaattctcaaaagttataggaagtttagaaatcaaaggagaaaattacccatgctttttaatactttcatgtgcctatgtaattttaaagtagttataatcaagtacaaagtatacacaattttgtatcctgtttttaaaagctaacaaatacagtgtttttatatgactatagacatcacgtttatagttttttattgatacacagtatcttacgtatttatggggtacatatgagtatctgttacatgcatataatatataatgatcaaatcagagtatttggggtctccatcaccttgagtatttatcatttctatatattaggaacatttcaagtcctctgtgctagttactttaaaatatacattgctgctgactgtagtcaccctactgtgctactgagcattataacttatttcttctgtgtgtttataaccattaaccacactctcttcgtcccccg

SEQ ID NO: 16484 - DNA, 1617 bp, Homo sapiens
tccctcttccctgctaccatttctaaaatcttttcccaccccatgtgattctgatgtgtccacatccaaagcccccactccttcccctgttgttctgtcttttttttttttttttttttttttttttttgctaaaactgttatgaacgatgactctcttctttttggttcacaagtcataggtatgcaggcctacattgctgctattcttctttcccatgaaaaagcctgtgttacactaggagcaaataaggttaatatgcaaagtaatgtggagacagagcttgctgatagagagagaaagaactgatgctattatttaagtccctagatccactcaaggtagtagggttgttgtcagggttaaatgagttaataatgggagtgctgcagccactgccgctgattccagatctcattgccacacgccccgacgactgcctgatgtgcattcctgattccttttggttccaagtccaatgtggcaactctcaaggatcagctgcttcataatcttctaaaggaagaacagaccgcccagaataagattacagttgttggggttggtgctgttggcatggcctgtgccatcaatatcttaatgaaggacttggcagatgaacttgatcttgttgatgtcatcgaagacaaattgaagggagagatgatggatctccaacatggcagccttttccttagaacaccaaagattgtctctggcaaagactataatggaactgcaaactccaaactggtaattatcatggctgggacatgtcagcaagaggaagaaagccgtctcaatttggtccagcgtaacgtgaacatctttaagttcatcattcttaatgttgtaaaatacagcccgaactgcaagttgcttattgtttcaaatccagtggatatcttgacctacgtggcttggaagataagtggttttcccaaaaaccatgttattggaagtggttgcaatctggattcagcccaattccgttacctgatgggggaaaggctgggagttcacccattaagctgtcatgggtgggtccttggggaacatggagattccagtgcacctgtatggagtggaaagaatgttgctggtgtctccctgaagactccgcacccagatttagagactgataaacataaggaacagtggaaagaggttcacaaactggtggttgagagtgcttatgaggtgatcaaactcaaaggctacacatcctgggccattggactctctgtagcagatttggcagaggtacagtgaagaatcttaggcaggtgcacccagttttcaccatgattaagggtctctatggaataaaggatgatgtcgtccttagggttccttgcattttgggacagaatggaatctcagaccttgtgaaagtgactctgactcctgaggaagaggcctgtttgaagaagagtgcagatacactttgggggatccaaaaagagctgcaattttaaagtcttctgatgtcatatcattttactgtctaggctacaacaggattctagttggaggttgtacatgctgtcctttttatctgatctgtgattaaagcagtaatattttaagatggactgggaaaaacatcaactcctc

SEQ ID NO: 16485 - DNA, 1134 bp, Homo sapiens
gataataaatgagttcaccctttttttttctttttttccctgagacagagtttgctcttgttgcccaggctggagtttaatggcacgatcttggcttaccacaacctctgcctcctgggttcaagcaattctcctgcctcaggctcccaagtagctgggattacaggcatgtgccatcacacccggctaatttttgtatttttagtagagacagggtatctccatgttggtcaggctggtctcgaactcctgacctcaggtgatccgcccacttcagcctcccaaagtgctgggattacaggcgtgagccatcatgcctggccgagttcagcttttattcacattttttccccaaagtgatttattcttcaaagtagacagttatgttctatagagtgttttgttttttctttaagaaaataatttacataaacagagattatggtaaacattttaaatcttaggctgttggttaaatttaatggtttaagcactgttgggttctctttaattaatatttgcagaaggagaacatatgtgtttcactgatatgtatggtccagaaaaattacttaattctcaaaaatatgttgcattctcatattgtgttagggaaaattccataagtagtctatttttttttttcttttgctgactgttaacatccaaacacctgaatgaaaactgactcatttctgtattggtgtttaaaaatattgatttgcagatgttcacagaacacttgcattttttgattcacattgctaaatcaaatgtaaaggcaaatatgtatatttaataaatgagaagtatttttttattactgaaatttattctcaaagcaaatgtattttgtagatgtttcatttgggagattttgctttgccttaaaacatacaaaataaacctgtcttgtggtctgcccacctcaaaacctctgttaacttgacatgtagaaggagttcagaattctttgataatgtgtggttttcacttttgtttggattaaacaaaaataaaattagagtccatagcactttgtaaactaatgtgaagtttcttgttgaatcataaaagctacctgtatgtactttataatttaatgttctgttagtaaaaattgtcagcatttta

SEQ ID NO: 16486 - DNA, 5210 bp, Homo sapiens
tttattgttattgtcttcaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaaccattcccacttggagtgttttatttttcaatcatcatcattgcccccaactccccacatgtatgtgttgtggcatccagagtgagaaaagacaatttatgagttgatgaatctgggccttatttctatttccattttgaagaataacttgtcatagaagcctctgcagtttaacagaaggagccacatattgggagtcacgagttcatctctgtgggttaatagttccatgacacggagtacgtagctcagcttttcaggggttcagttgccccactatggatagcggtgtggtatttggtacttgtgagggctcaattagataaaacatatgatagctttttgtaaactgtaaaaggctatacaaaagtatgaattattataataattatggttttttatgtctggattacagtatcaacacaaaagtattggctgatactgtggtttgtgttgtaaaatgaaagaagtgtagaaattcaaataccttactgtgtattcatgtgtttgatgttgacagtaggctacccaggttatatgaacctgctcctgccgttccctgccacatggacctgtatcaagcagtgtgtggcttgttttcttcaaggtactgattcttgaccaacactgaggatgtatatccaatgaaagatagatatcaatggcggtagatatcaatgtgttattagtaatacaactttaggtacagacaaaatagaaaataaaattaactgtcattataattagtagtggaaaatacattaaaaattatttgtgtatagctttggaaaaaagttttccaaaaaaagctttttggaaaaaagctcttagaagagctttggtaacattatttttgaaagcgcacactcacattgtgactgtgggtatactgagcatatattcttacattgttactgtgagaagctgcaagtcagtgctgcaagtcagtaacaaattctcttttggggataaaatgaaacagttttaagcttagagtggccatttttattttaactctgcattactaaacaaatataaaagaaattcatctccatttaaaaatcttttttgttatttatattttgttttatttttgtttcctattctttatgcagttacctgatactatggacagtatatccagtggatcttttagtactgtaatatcaaaatgctacaaatatttatgtttcctgctatgttcaagatattgtagtggcaccaacttcttgggcatcagctaatattgcattttggagtcattagggtgttctgtgaagaatgaatactgaagtgacagttttatctagttttttgaggggcatttatgatggggttgggttgccattgtgtctgacagtgcaattcatgtagttcctggcataattgccttttttttttccttaatggagaggcagggttctgattggtgctgtataaatttaagtaactttgtgctttgtaggaatggtgacaaggaaggcatgatttccccctgacaaggaatgaaaggtgaactgtatcagctcttatctggacatatatgttaatgttttctatgctccctgatacaagaagtttccaagttatataggaaaattaagtccattgatcctgtctttatcctcagagggcagaaatgagacaagtggataaaggctgtaggaagctgaattccagattaatcagtgccgaggaagatttttcattatcggaaaacccaacagtctaaaatcaataaccagttcttctgcaaaggggtgagtttaagcagggctaatgtgactgtcatttctgcctgtcctgcaagcttagactagttgaactttgaggtcactctatgattcttttattagggcttcaaatcagcagggagtgtgtaaagaaaaaatgctccccccctaccatttcaaataaaagtgaatgttttctctttcaaagctactattagaggtagttgtgatagacactaacaatccccggtgttaatactttccactccttttattttattttaatttaatattattttattgagacagagtctcgctctgtcacccaggctggagtgcagtggcgtaatctctgctcactgcaagctcctcctcccaggttcacgccattctcctgcctcagcctcccgagtagctgggactacaggcgcccgccaccacgcctggctaattttttgtattttgagtagagacggggtttcaccgtgttagccaggatggtctcgatctcctgaactcgtgatccactcctttttaaagtgagtctagtctgttgatcttcataaataggagggttttcctccagcttggacattaaaaataatttttaaaaagatctttgtggctaactggaaaatcttctggaattatctaatgcttcattcatttccctccatttctgttttttttttttgtatttatactctgcatatttagaaatcttaaattcaaatacatttagttaaaatgagttgacgaagactccagtgatgttttaataccctaagattttgtgattccttgggcctggaatggatcttagaaaattaccttgccctcatgagcctgtaaaccgtgttgtttcccctcagtcttgctctgtccagtacagtagcccctcgccacacatggctgcggagcacccggaatggcttacagcacatgtgggaatggtgctgaatgctgaggaagcattcactcatacgtgctgcacttcttaaaggcctcccaatagcctgctttgcggagttctggcttttacttgctgtctactatgatcacctgatttgtgcttcacatacatatctgtgaagtttgctttttctatttaaagtgcccttaaactttcatttgatcgtgtttatctgcagatggtcagtgtcattggcatatttgaacattattctgccctccctccgccaaactccttatgtactagattaagaaattttatttttgagatgatgattttaatttgattttacagacattcttttttacaaagtacagttgttagagttatagaagagtgattcacatctttgagaagatagatttcatgattaatatatatattttttgagacagagtttcgctcttgttgcccaggctggagtgcaattgcacgatctaggctcactgcaacctctgcctcccaggttcaagcaattctcctgcctcagcctcccaagtagctgggattacaggcatgtgccaccatgcccagctaattttgtatttttagtagagatggggtttctccatgttggtcagtctggtctcgaactcccaacttcaggtgatctggccgccttggcctcccaaagtgctgggattacaggcgtgagccaccatgcctggcccaatattttctaagataaaattattctgagaaatctagtggaatcttttccattgctttgttattaatgtttcaacactgactttctcaactaggccagtattactatttaaaggtttttagaggctggcaatggtggctcacgcctgtaatcctaaaactttgggaagccaaagttggggggcgtcacttgggaccaggggtttgaggccagcctgggcaatacagtgagaacctgtctttacaaaaaaaaaaaaaaaaaaaaaaatgagccgtgcatggtggagtgcacttgtagtcctagctactagggagacttaggtgggataattgcttgatcccaggagtttgaggctacagtgagctaagatcatgccactgcactccaccccaggtgacagagtgagaccctgtctcaaaaaaaaaaaaaaaaaaaaaaaaaatatatatatatatatatatatatatatatatatatatatatatataaaataaaggtttgtggacacatgttacccatttagagaataatttatttttgaatgtgtatga

SEQ ID NO: 16487 - DNA, 1198 bp, Homo sapiens
gaatacgttttctgcatattggattacattactggaccgtcacatgtttctaattgtatgaaagatcctaagcccagtgaaatattccagtgtttatatccagtgatattcttggaaacattttatgtaaacaactggcagacatttaaaaatatttttctttacttaaaagtaacaacaaaagtttacattaaacagaattattattcatagtatcggtttaaaatatttatttctgtatctgtattctattaccttccaaaagaattaaatgcttgtagatatttaataaatatttgttatatgaatgagtttaaatttttggtaaaaatatatatactgaattgcttcacagtataaaaggcaaaagcaaaggaaaatgatctgtaaatattgtcctgaggttcctagaaaccgaagcaaaacacatgaacattgtttggggatcataaaggacattgaataacctcatataactgcaaatggttttcatttttcctcattaggaaatgatgtatgtctggaatggtttttcaatagtgagcaaaagaaaagacctttctgaaaatctgttagtaactgttgaaaaagctgaggcagctttacaaagtcaaagtaagtatacacagtaagcaccgaggagcctttgtctctgctccatgactgctctcctgtcttttccctgtgcacatctgccaacattaatttgtgtacatcccaaggacaaagagcttgagctgcaggggtctgggtgattgcagtcaaatgcagggaggaatgatacacactgcaactgcatgaaccttggaaacagcttactaagggaaaaaggccaggccagccataaaagaccacatattatatgattccctttacacgatactcagaatagggaaatctataaagacagacagcagatgagtggttgcctagggatggagtatggaagttaggagttatgatagctttctggggagggaggtgatgacagtgttctacagttgactgtggtgatggctgtacaactctgtgaatatcctaaaaaccattgaatggttactctcagtgggtgaattgtatggcatgtgaactgtatcttaaaactatgacaaaaaagatgaagagaggaagcccagcattggaattttagcgcagcacaaggaaacgtgcacttccctctgggttgagtttgctgtga

SEQ ID NO: 16488 - DNA, 2375 bp, Homo sapiens
tgggattagactagatacaaggtctgacaactactttggtcatggctcttgtgaccagcctaacttattccaaaatcttgtttgctcttggcctttggctggcgaggagagggattattttatataagcctttatttttgaaaaaatatatcagaatctctctgtcaaaaaatacatttccagcggcctttattttagcacttatttcagagccaaaggccgtgtgctgcccctttttcaacagaaaacagtttgcttgcaatctgcctgcaggctgccctcttgtgttgaaatagggaaatgcatattgtccccttcaacctggaacattttgttctgcctgtgtgggtttacattggaaagtccttggtacttgagtttttaagaggttacttttcaccacccatataatttcagtgattatggtgaaggaataaaggttactgtgcaagtcaggacatgcatttactaggatttcttatgatcagtatttccattgaattaaaatgtctgaattccctgtgttcttcccagggctaaggagagtatgtaccatgccttgggctacagtaccattgtggtgttgcaggctgtcctgaccttcgagcaacaggacatccagaacggcatttctgccatgaaggacgctttacaaacctgccaaaagtatgacgagtcattaaatacttaagatgtgactgcaaacttttatgcctgtgtgacaaaaataatgtcatttgcctgaccaaaagctctgtgtttgaaattggccacagttacagaaaagaaattcagcctcgaagctgaaggattcccatttggcatctacatattccacttttctttttgatagcctggggtctgagctacagagatctgggggggatttcggggggatttcagtgggattagcagcaagcatctctcaatgtagatgacattaggtactgcatgccaaaccaagccacacaaggaacattcttgttttaagtgggagatgcaaattcatgagggaatgttttatttgtttaagaaggacctgtttttgaacacttttgtttggtgaaaatgagatagatttttagttttattttaagctttactttgtgtgtataggaagaccctatcaaaatttttttcaaggggtaagttattttgatatcttttaaaaaatgataggtgtttcacagtatggaagatgcttggtttgtggacatttaggaatattcaagaatccaggaatggctggctgcagcaccctgatcagatggatgggaggaaatgacccctgttgctgtcaattgcttgatgtgccccccataggactagggcagaaggttcatgatcagaaggttaacatgggtgaaattacatcctgatgtaattgtgttgtaagctcctcaaatgaagagagcttccaaatattgcactttaacttcatttttaacctgtggagaattttaccacaaatactgattttagttatagggataagggaaggtactttggaggttagttttcattggtgtgtgtgggtttccccacgtggtgttcagtagcacagactgagttcccacaaatggctagccagtgctgcatgtagagtgttggaaaaggatgatctgtgtcctatagacttcagggtttagagtttcagctttttgactctttggtgtgatagtgactgaaatgaacgtcaaatgaaaatgagctcagcctgattttttttttctattttctatctccctttttatttattcaatgtagatacaggaaaaaatacacagttgtagaatctttctcaagtcttctttctagaggatccctggagcaactgagtgaaggtaaaagtcatttaaaagatcacttttttccttgattttaatagttaaatgatcatctcataaaattccatcctgaagtatataaagtaaatggaatgtctttttctcttccctatcatactcaccctctggaagaaatcattgttaatagttcattttgaagccttttctgtgtacatactcaaatacataaataaggtacacataaggtttttgttgttgctcatggattgttcattttttttttgcaagcatagaatcacataataggtgttgtcctacaatgtgaatttgacattgacacttccccagatcgttacatgtgagtgtttaacagctgtgtggtattccataggattgatatactgtactttacttggcttttctctatggtttttattttttcactgatatgaataatggtgtcctagaatccttatacatatggattcatgcattttaaaaagttatttcataagatagattcctaaaagtggaagaaccaggactgacagtttgaaaacttacaat

SEQ ID NO: 16489 - DNA, 1144 bp, Homo sapiens
ctccagctcaggttaacaaacagacattctcctgaaatgtttcctgaaatgttcaatcttgagtctcttgaaaccctgttttttgacagctgtttttctagtgaaacttttcctccccctgtacctggatacccacttccttcccttcaagtctgggtaacacatatgcttctgcagacaagtatcagttcttcctgtgctagctgcttgccttcttatctcagtttcctgcccatgggtgctgttaccagtcatttagtgtgaatctgatactgtgagttcagtgaagctcagagtttccatctagccatctgttgacagccgaccaatctccagtcttggatgccccagtagcatctcaggcggagtctcctgaagttactttgtattcacttcccaaagatgagtacctggggactcctgtgggtgcttttgaggcttcctgggggagagattttccttttttgagcctcccattggccaccaccttagtcagcactctccttttctccccctgtgcttcgtggatctgtgctgcctcctgatgcaccaagtccgtttatacccagagccaccgcggccagttgctgtattggtgatgtcatcacacctctctaaagggacttctgaagtggggagtgcctggcagttcctaatgccatcatgcatcttcagctctttatttaaagactaggtgtgtagtaaatgctttttgttgtgatctgtggatgtgtccccttggtactgctgatattatgctgtcatatacatagggcctacgtattttaaaatattttggtgaaatgatacattgtatgtttgttggatctgaaggtaactagtgagtgacaattttcagtctgacttaatgtgttgagtattgtgttaggtgctggacaagcaaatgcagctcctgcctcaggttatggtctagtggagagtggggacatgtgtgttctgagaaccacctggtggaggagggatgccagggtactttgtgagcacagaggagggcacctctcctgggagagagggtagtcaggaatgatttcctggaggaggccatttcttagacattctgagtcaagaagaatgagtaggggttagccatggagaagtgatgtggggaagggggagctcttga

SEQ ID NO: 16490 - DNA, 2311 bp, Homo sapiens
cttatacagttttaacttacttagatttattctagttaagccataagttcaacgtgtaaacttgttttcattaaagaatttttctatcaaactctgctagtaaattactttcttgctatttacaagagtaagtgatggaattctgggtttgctgccaaggaaataatttcttagttaactggtcacagaggttgtgctgttttgggaaacggggtaactaaacagtaagctcaagatgataaaaaataaaggtaatatttatcttttgttcaccctccctttcttcccatgacccaccagatctatagttttacaaagaagccacagaatattccaattctagagatagagcatcattctcataatttatgtcagcttgtacaggctgaccttgctctaactagttgatgtatgttcgcttcaagcataattgctgtttctttaatcataactctcaagaaatggtgtcataggctgatttacagataacttctcagaactcttgataattattcataagacttaagaactttcaggatcattgaaattgttcattggctcaatttgtgtgtgtggtcaaaactccacagcttgacaaggcaccaaaaggtaattttgagatagataacccccaccccaccccaccccaccccaccccacccctccaaaaagtacgtgtaatatgtatgttttaacacctcttttgggctggtatgtgtgtgtatgtacgtatgtgttttgattactggataaaagagtcatacatcagccgggcgcagtggcacgtgcctgtaatcccagctcctcgggaggctgaggcaggagaattgcttgaacccgggaggcagaggttgcagtgagctgagattgccccactgcactccagcctgggagacagagcaagactccatctcaaaaaaaaaaaaaaaaaaaaaaaaaaagagtcataccatgaccaagcagaactgaccattgaaggttttcttagctgcttggagaaattgcagatacatctatctgaatctgagaactgactgggatttggtatgtgaacaactggagagaaccatacactttataattaatattatatccagtgatttcaaataatatgatagattttgctgatacagtactgctgtctgtgttcctactcatacacttacctggttacagatgttaggtcaagatgaggtctgcatctaatcctgtataagagcagagatttttcatagggtgctgtgagggctttgctaactctattttgtccgattggccagaaaaaggatgctctaatggaaatagcaaacctgtatcattaaactctttagaaacaaagaaactggtttaataggcagaaatgtgtttatgtttgtgtcgtgtaattctgcaacacaatgttagagatgactgacctttctcctagtaaaactagaatgtctaattgtccttaaatggtactgatgcctgaagaatgtttaaagaaatagctattgcttctctagtaacttctgtgcatgtgtatccactattatataaaagtcaaattcaactaccaagcaggttgacatgttcatgacaacattttcagttgcctatcttcattagctaatgtgttacatgtaatttgacaggcgtgttacatttgattgaaataagcataaagaaaagctgcctcgaaaaaagagaaaagctgtcttaaatcaggggttttatagctccagaaatatacaaagttaggaatttcttttgacttgaacttggtgggatacctgtataactgatacataacacacgggcaaactgtgggagtaacctggttgattaacttttctcctcagtttcaccagggaacaataataggtacctgagtctttgatgaaaaacttaaccttaagaactagcaaaataacattctcaaataattaataaagaatcccagtagcagaaatgttttaactggcatgtttcttctttgtccgctaaaatgtattgacaccacacatggaataatgcattatgacaataattaactttttgaagtttggtgttttgagagtatgaaatgaatgaataagataaaatatccttgcatatgcatgtaagacctataaggaacgcagtattgaaaataaaggaatcaaaatttttacccatggaattttagggttgggtaaatcattcatttatcttaaatctatggtttgctggcagttatcaatctgctcaattttagcattgttgtatacaagaaagtaaaaatttaggtataacataagccagcctcttaagttctctatactgattatct

SEQ ID NO: 16491 - DNA, 1167 bp, Homo sapiens
cttctcggaatccctgcctttttctctcccatgcaccccctcccttttggggcttaagctcggtggaaaaagcccggagaaagatggggcgggcagacgggcgatttctggccgggcagcatccctgcttcaggtggtggcgtctcttcggtggcggggtggaggacctgctccagcgcggaggcagcgcactggcgggggaggagcgggaggcggccgtcccctcgctctcccacccccacccgccggttcccctccccctccccttgcggcccctcccttcggggttcttcgctttaaccgccctcggtgctctccctagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtaagtgatttgtagccctcgcgcttagcagtgctaccctcctctccagaggcctgctgcccaccgtgtctctttattttttcttctgtcctttctctccctcgctttagtctcatttgtaacctgacctttcattttagttttttgcccaataatctcccgtgtaattatgaaaatccagacgtttctacatacctgtgtatttccctatggtttattggcagacttggacagattttcttcctaggaaatatttaaatgcgttgctagttaatattccattgtaggtgaaataatgaagagtgaatttttgtttaaaaattagtgaaacattgacatttccatagttttggatcaagtacaaaatatcaatggaatttgtgcagattacacacaaacacttggatgtcagagaagtgcgtatgtgattaaattggatttacagggttttaaaaaaaataccttgtacttgatgaggccttctggatttgcttgtttaatacagattcaggactggatattcttgaaagtattacagtagtttagtaccgaggaagggccagaaaattcatttctccttttttatttgagatgtttatgaccttgaagaagttgttttacctttttgtttc

SEQ ID NO: 16492 - DNA, 1193 bp, Homo sapiens
atccaaatcttttttaatccaaatgattttaatccaaatccaaataacaggaggttaaaaaaaaaaaaaaaactaagcatttttacatgtacactgaattggatcagcattattgttcattataatgctatatatatttttggagcaacatactatagttgtcataaaactatctttattcttctcctctaaagtgctgttgtaaattcatttgacctttactgcaggaaaaaaaaaaatcttttttatataggatatgaagaccaaggctcagtctgtaacaaatagtggaccattacaaaagaggaaagaaaaaagccagggctgagcagcaagaagcttcagttcaatttcacctcgtatctttctaataacatacttgtcactttattaccttccagtaatgtgaacgctgctgacaagactgtcacactaacagcagacaacaccctctctgcttcagcccagctctcctggctacttattgccctggccctgaagggacacaaactaatagtgtgctttccagttcagcacttggccatcaaatataaaaggatgcgtaattgcctgtttatccccttgtgaaggagaaattgactacaagggctaggctttcccatcgagttccctgatgtacacacacatccacaatcagtcagtctctctctctctctctctctctctctctctctctctctctctctcccctctctctctccttccctcttattctcccctcctaacatacaagcacatacacacacctactgtatctgtgggaagcccaaggctgcctctcgatgccctctccagctattaagtggacagtaacaagatgacttcttaaataaagggtcagtagagagatgctgtctgtgacggcatcctttgcttctttgaaaacttaagtgttaacaattccatcttgagagtaatgggtgtggccctataattagagcaaattttcctgcaagtcagtggcataagtaagattatattgccccctaatctgtagggaaaagattaaaatatttttcttccccttcaaaaagtgcacatgttgtaaactggttacgcacagtggtcatttttttttcttatccttggcatcaaaccatggacgtaggtgtacaaatgcatctttcaatgacccctccaaatccatagtgtaacatgatagattaactttt

SEQ ID NO: 16493 - DNA, 2727 bp, Homo sapiens
ctatagtatcactatttaataaggactaaggtaccatttttttcatttatattggatttcacagcaagagttcacatcttatactaatatatgctaaatagttgcatagtatatagatcattgttgttaaaaaagcagtactgaaggcattttagatcacagagccccagtggtctacattttgtttgctttgacattattaaactcaatctgtttctctaactgtgactctaattactacatttgcatggcagaaaagtttgctttgtgggttgacttttattaacagtgcttgcatgttgttttctgctcttgctcagtgttttatgagcacacagagcaccttcagttgcattgaataattatgcacaatcaataagtttttgtgtttgtctttgttgtttctttgatgtggcctctaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacaggtcagtaaatctccattggctgctcctgctgggggtggagggtgccagttttcagtcatgttggacttcacactaaaagaaatccaacttagatgtttttggtgcactgtaaagattgtccacagtgatcatgtgataactaggctgccatgctcatgaaggattgttgcagttggtgcttgtgatgattaagcatgcagaatcatgtgccatcttacccgtaatgcacgccatttttctctgtgctctgtgtatacgtgtgtgtatgtgttttcatgcatctaggtgtgaataagttaactatgtacacggttccctgcttccccgtgaacctt

SEQ ID NO: 16494 - DNA, 1181 bp, Homo sapiens
gtgtgcacaaattactttgaatataattgtatatggcgtttttgtaaaagtaggctataaaatgtgtgtccgaaggctgtggaaccccataatgctctattagtgtacaagtcattttatctggctaaaactcaattgtcttgtagccctcaaggcatcaattttagcattattgctctcaacaacagtatattgaatattatgtcagttaaaggagaataattatcaaggcaggttagggtggctgttagtcttaccacatattgacttggttagcagttggctacagattgtgttcctgggcaaatgaagatgtacggtaagttgaactagtcaagccaggatattaatttaactctctgtgggacaaagcctgcatcctttatgtgtacacagctactcctgccttctgagatacctttaaatgtggaagaatgacagttgtctgatctgattttgaatttttggatgtagggggaagaggggagcagaactttcaaaagtatgtggtttaagaggttattattagaaaaagggagatgatagtgatgctacagatacatttaaaaggctggcacatcggtcaaggatcctgtactttttttataaagttaattttcacctatgtgagtgtctatataattcacaagctagccagttgggtataaaatgcataacataacttggactacaactacttaagaagtcaggtaatatattaagaacccaatattctcctgtgtacttattaaagtatttattcagaaagtacagaaagttagcttttaagcattttccagaaaaccacaaaaatgggaatatgcaattagatgataaaatctaaatacaagggagaatatgatgtttttctactactaaagaataattctggccaggcgtggtggctcacgcctgtaatcccagcactttcggaggccaaggcgggcagatcacttgaggtcaggagtttgagaccagcctggccaatatggtgaaaccctgtctctactaaaatacaaaaattagccgggtatggtggcatgtgcctgttaacccagctacttgggaagctgaggtgggagaattccttgaacccgggaagcagaggttgcagtgagccaagattgtaccattgcactccagcctgggcattgcagcgagactccatctcgaaagaaaaa

SEQ ID NO: 16495 - DNA, 1257 bp, Homo sapiens
tgtcagatattatgtgttatatcagaaagcattgttgagaaaaattcccggggaagggccctagcttccccttgccctgtgcaccgtgattgtggtgctgcctggagtgtgcataagtgtgtatctatctgtatatctggagaggggttagtgcagggtgtcatttggtgcctgacagtggaacagtgcagttgactcttagctctgctatccaatgacatgcagtggctgagagtttgaagctgatggttgggtctccagtgccgcctgcacacctgacaggcagctgttaaactgagcaaaggcaagcttggggagtcacaatctatgcataaatgatagggatatctgtgcagaaggtgcgaaagaagctctgaccccctccctcccccaaatctcccccttcccaaatgaaatgcacagttcagccagcttcttaactacactacactcctgctactggctgccaagaggctcaaaaaatccaccttcacttttcagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggtaagttactttctttcttgattttttttttcttttttttaagaaaccttgaattgttatgggcacttttgtttctggtgtttttctttctaaatactttttaaaatgtggtcacttcctagttaggctcttgttttgtcataactgtgttactggaatgtgcagggttacttcatggtttccctaagggcgtcttaaaagaaaaaggggaaaggataccgaagtaaaagaaagcagagacattgttgaaaagtttcacagtacaatctgggtcaggggaagacttaatttatttctttgttttctgttgagaatgaaaaaagccacctcccaacaaatgtatctatcaatatgaatcacttcgtccaaagtgtttgctctctcggagtaggttccgcaacctaaaaaacagtcatcaaatctcggggcccctcagaacagccctactgacttcatgtggctggaggcagcttcgttcagacctgagaagagagacgaggctgtgcaggcttggctgccagcgccgagggttgctggaggagtcggcgtgcgtgg

SEQ ID NO: 16496 - DNA, 1183 bp, Homo sapiens
gacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatgcagagttctatttatctagctgtacagactctttcagaggtttaacgtgctgcttccgatgtgccacctgcagtagtggatcatgtggagtgaaaggcaaatcttactgcttaat

SEQ ID NO: 16497 - DNA, 1095 bp, Homo sapiens
gtctgccagcaatctttagcatctgtcagcctgtgaatgtgtccctctaatcctcctttgcatggctatcttcccttctgtgaatctatgaatttgcttccagcttttcttgtgtagggtgttcttcaggttgctacttcaaggtcaaggtctgattcaagcccttcctcttccagcagtgttgccctcaccatctcaactcattcaactcaaccctccttgcaatttgattggatttactgccatttacattctacaatacttactatgtggctgttctaagtagagtgctacagcatcttatctgacgcatagccatcttcccctctgtgcatgtctgtcatggtgtcaaatttcccctttcataaggataccattcctattggattaggatccaccctagtgacctcattttaacttaattatctccataaaggccctatttctaaataaggtcacattctgaggtactaggaattaagactaatatatcttttgcaggaacacaatccaacccataataaggagaaatacttaggtttgtagggttttagtgagtaatgccacctacaaatcagtaaatagagacatttatagcctgattggatgaatgtcaaattatttccttaatcccaaggcacttgatcctaaatcttaaatgccttgtggtctacttgggatgataactagggggaaaaaaacatttaagcaaagagaattgtgtcagattaaatgctatagcagtttacttagaatagctgtgtagtaagtattgcagaatgtaaatggaagtaaatccaatggaatctcaaggacggtacagttgatgtgagctgggatggtgagggaaaccttgctggaagaggaagggcttgaatcagtccttgatcttgaggtaggaacatgaagtcaggaaaagctggaagcaaattcacagatgtgaaagagaaacatggtgtattgggaagccaacaagtggctgtgcctggcagaaactcactctgtataaaggaggtaattctagaaaagaaaaagggttcatttagtggaaggtttttaatgtgaagatgctaatcagttaatataaaatagaga

SEQ ID NO: 16498 - DNA, 1732 bp, Homo sapiens
atttgttgaattggatacaaaactaagatggaagagattctttctttttctgtattttagtgaagaacacaggtatatccatctatcatatgttgcatgatttgtttttttaaatgggtgtttatataaatataggatgaaagacaggttatacattaaaatgtccctgggaggcaagttttaaatagcttttccagtgcacttttttttatactttctttatggcctctaaattttctggatcttttattctgagtatatgtcacattcataatcaggaaaacaataaatattttaataaaagttaacttggaaaataggttcattgttaatattttactttcccttttaggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggtaagaaagctttatgtgtgtagtctgtctgctattggagtgtttatagtatctttctagaaatatatgtattcttgttcagagatttctgtgcccaggctggagtacagtggcatgattttggctgtctgcaacctctgcctcccggctttgagcgattctcttgcctgagtagttgggtctataggggtgtgccaccatgcccagctaattt

SEQ ID NO: 16499 - DNA, 1233 bp, Homo sapiens
ctttggtaagttgcttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggtgagggttacttgtgttcaattttcgttgaaattgatttaaagccagttgtccaaatgcttattcatttgcagtatccagacttacagaccaatggatttgtttctctaccatcaattcaacattaaacattctgatttaggattcttaaggaagttgttgaattaaaatctcttcaactgtttcttctaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaggagggattatgcaattagggcttgcttaattttggtaatttgtctatcattttgtgtgcatatcagaagataaatatgtgcctttggaaggccttagcactattcacttggagtttttacagaaaatatttgggggtggccagcatacccagttggtgttaatccttgcttattatatccagtgccttgtagagtgcagtaatttcgttgaaaa

SEQ ID NO: 16500 - DNA, 1197 bp, Homo sapiens
atgattttatataggggtgtgtgtgtgtatgtgtttgtacttaagtaaaagtagttttgttatttctcggctggatttttcttatgtctattaagtataatcactgtctattgagtcagtaactaatttttaaaggagtcttgaaatgctatctccccctaactgctcactcacagttaaatattctgttcatgacttgaaagcagacatcagtttaaagggtatgaaaagcaagacaggttctcactgggaatttctaaggcttaatatacctttgacttatcaagttgactgagacagtttaatgctattcatggtatgggaccttgttgctataaatacgaatatttatcacttgattccatatttgatcgcccctccattactctctctttgccttttgatgtttgctgcgtattgcccaaactttctcttcttcactcctctagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagtt

SEQ ID NO: 16501 - DNA, 1137 bp, Homo sapiens
tgtggcaagggcattgtgggtggtggtaaggtgcatgtaggtgatagaggttggtagtaggagagaaggaacatcttctgaaaataactgttattgtcattgaaggcttatggcataaatagtatttggagttcaactcaggctagctgatatactattagtgtctggttaaattgtttggttagagcaatgtgctagagccaagttttagctttgttgtgttgcttgaactcgggtcatacctctgcctgcagccagccttgttttatagccatgataccaggtgagagagagttgctgtatcaaaacacatccattacctctcttggaaaattgacttcattttattctaggaacagagtgacaacagcatcatctttataaaggaaagctagcctactgtgaacaaattactcattgatgaatgaccaaaggtgtgtgtgtgtgtgtttgctgctcatcagaattgtcttctaatcactggtttggtttcagactcctgctttgaacttgctgtgggagaagtgttgcagtgacaatgtagtggttcgaacagcctgctgtgaaggtctggtggcactcgttgctcaggatcatgcagagttcagctatgttctcaatgggatactcaacttgattccatcaaccaggtactttttcctcagtgtttggtcagttaatgatttaagtttttaggaaaaaaattcactaaatcactattaagagtcagcattcatcctacttgccagttgtttttcttgctcttaaaatgtcatgagttgctgtttcatatatgaaaatatcatgctaatttaaaccctatagtttcagaatttgtggtcatttgcggtacttaagttttggggctctacttaaatttgtcgttgccctttttaagaagaaaatagctaaacagtttataattcaaaaatgtaatgcagattcctgacattttaagaaagaaggttgtccataagcaatgcttcttccacagtggtatagtttatacattgtagtggcattacttggccaggccttggcattagtgtattagaaaataatggcatttatttctcaaatattttgtgatttagggatgtcttccccctgatttttcaaagttaataatgttttgtt

SEQ ID NO: 16502 - DNA, 1199 bp, Homo sapiens
aggaatggaaagaggccatatgtaagtgtgacttcaacatagcaaggaggtagggtattagacattaactctgagggggagtcagggctagattataaaaggtcttgatcatggtcagaagttgtgattttattttatgcacagtgaaaagcaactggaaggtgttagggacaggaatgacaaaattctggcctctgggcagaggaaggtttatagaggatggtcaagaggaaaagaattcagtaaactagtttttacattagtttgtatgaggaggacaaaagataataagtagataaatagcagtgaaaaatggagagaaactgatggatttgggatagattttgaaggtggaatcagaaggacttgctaatggattacatgtaataagtgagggaaagagaggaattaagcttgagcaacttggtgccatgttctaatttggaggaagactaagaaagggataggtatcaagaggtctctttttaccatgtaaggtttggccagaaatgtagcttagttgtttgtatatgagttaagaacgcatgtttctcttctagcttattgtatttactctacttttggtctccttttatcctcttttagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtaagggtagtacatagtatcaaaaatacaggtttttcatgtaatgatttaacttccactttcaagtaggatataatgggccatggcagggtgttgctgctgctactaacatgtggataaattataaaaatcatcgcactttaaaagacatcgcagaactgtagaagcaaagacaaatagatggatttaagtttcagagtcagcataacattttagaactgttttctccccaccttgggggatacccactcagcccagaggcatggcctgttggaagaaagagaaactagaggagcttttagtgattgcctgggactagggcgacaaattagagatttttctcacaggacatttgctgaattttgaatttgcaccaagagctaaagagctaggctgaaagcttctga

SEQ ID NO: 16503 - DNA, 1145 bp, Homo sapiens
ctcacatcctgaattttagtcttttctctccttatgcagctgatcacagtatactcaacatgcaggtaggggtgttgcagggaaaactacagcatttctgtaagggcacaaataaagctggtttatgccttttcctcttctcacccataaagtttaagtcaaactatttcctgccttttgtttttatctagggggtgtacagcactagcatgggccacagatacatgttttgatgtcaggttttcattttgaggggagaggtatgtgtacttgtcatggatgatggggcacaccatctactaggcagcagaatttgaatccagccatctcaccaaggtttgagagctctgtaaacacccgtggtaagtgaagagcaattgtgtggatttcttatgatcctaacatcttatcttttttggcttccaagcacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtaagagatggaggctacatttttttcccctctgctctcttttgttttcttcttgccacttattttggacttaccatattttggtaaccctataaattaaattcttcctcaaagagaaaatctgaatgacaaacaaccaatattagatcataaggttttcatattatgtggcagtttaaatcaacttaaacctaaatgtggcatataagataagagcctttagtgaatacaaaacctaactcagcatcactagaaggcactttctaagaagagctgcaatttctggaagaaggttaaatcgagatttttagaattgtgctcaagccaaatataactttcaaaaatgcccaggaataagcttcagaaactgctgatcaaaaggcgtttgattttttaaaatgtcagctagcataaaatattattgagaaaattcgctttaccacacttagagaaaagtttttttctgttgtggtgcaaaaatatgcagaattggagttcatgtgatccagttcatgggtgttaaccatgtttttagatggaacatttcaggcatgtgtcatgcctgtctct

SEQ ID NO: 16504 - DNA, 1174 bp, Homo sapiens
aatgtttaatggaaataccatattcatgtagaaaagagcacaaattgtgaggagatttttacaaagggaacacagccatgtagtcagcaccctcatcaaggaaaaaaacatcaccagcatcccagaagtcagctttcattttaattctgcagaatttcccattaactgattgcagggtaacttaaaaaaaaaaaaaaaaacaactttccccccaacatttataaatggttttctgccattaaaatcctgccaaaatatcgatggaactccctagtcttgaacattagccaagtgagaaaaagacaaattctgttctgacacctttttgatcaaaatgaccttttcaaatgcagccatacctatattttgtccccttagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtcaattttgtgcgtgtgacttttgttttaaggcatgggggaaggtgccagaaccacttggtgacaatggcattatgatctattttccatgaatctccatgaggatattcattgactcagtgagttagacaaatttccttattgataaaacactctcttggaactgctatacacatttaaataataagcataacattgaatattagctaaatcagattcattaatggtgtctatcatttccttatgctttgttctcttgaatgcaagtgaaagttgtgattccaaatagcttcagccaaagattagttcacaaactaagaaatttaagagtagatctcatctgacacagctgcatccagtgaatcaagtgatgccgtcaggctttgttcctctcagaatcattcct

SEQ ID NO: 16505 - DNA, 1165 bp, Homo sapiens
atagctctctccaccttcctctaaagtttcacatttttgtcttttctctctatatgttgttcatatgtttgatatctgttaccttctagagataatcattattttggagatttgtgaaggttagagctgggaaaacaaaaatttaatagtgaaagttttttccccaatttcctggaaaatgattaggtttaatgatcaaatttattcaagggtaagtttttgttccatacatttctcttgagtctgtaacaccgactcccatttgcctgataggaagtgccagcttgaaaagccaaacaaacaagaaacaaaatggatataaatggaaacatcagaaatagccaattcttcttagtttgacatctaggttttatttgtagatacctgtgcacatggtcaaaacttctatatctcatacataatgcagctatattttctgatagtaaaattgttcttatttgtacagtgaaagtgaaatatatgatcccatgatgccctgcaaaaagcattataacctccaggggctttactagcaagatctagttcatgatgtcaggcttcctctttggtctctcccatgtttaccaacctgtatattaaggtagacggcaagcactaaccaaaaagtacaggaaaaatgcaaaaacaagaccaaaaaagccacttacctataaagagcatcatgagatatattttcagcacatatgggaaatagatggataagtcaaagggcagcttggtggaataagtgccaaatgattcaaaataaggcagcgattgatagatggcaaatgctgttaaaaaagaaaggcatcataaaggtattcctccttaagttgttacagggatgtgtatatatgtcttcatagttgtaggatattttgaatttgataatgacagttttgtaatagttgctgaatctttttgctaaacctagtttaatatagaaatctgtgaaatgattaagttggcaaggtgcttacagcagtatgacttgttgaatgtttgtccatggtataccttattgtgcctacagaagaatttacaatgtttcttaaaatgttatctcaaaatacatttgtccacctagccacaaataggggtgatagagagatgaacttggaaaatggtgcatatattttcctcttagagtttcacaacacac

SEQ ID NO: 16506 - DNA, 1190 bp, Homo sapiens
atacttccaattaaaacatgagcaaaaatagatgctctgttcctgacacttttaatccctacctcctaaaatcagtggctgtagggagatcccttgtctgtttcctcaagaactgctgaaagtaggacttctttttgagaagtaattcacaaagtgccaagtgacaagccatacttgcatgtgaacacaaagcgatgtttatctttgtccaaacaagtacctgttatggcatgcactttataaaaacagccagaaaaatgcacctcagttaatgggcactttaaaagagcattcattcatttgggttactgagaaggaccaactcagaaatgaccctgcttgcctaagagaaatatgccacaccatgatttctctaaccatttcaagagtttgctgcccttgatccctgaatgattttgatgtgtattttctgttccattcctctgtaggttggcgttaacctgtctaaccactcatagctctgctggactttttatatgagagttttctgcttggttagttatgagtttaaaagacttgagaatactggttttaggggaaggttttgaaattgccaccttgcatattgtagaacactttatcaccacagttaaaattgtaggggttactaattgaggaataatacaaattatatttcagtaacacagaagatagcaatttattatcttcctggacttggggatacttttatcaattaatttcaaactgcggtgtttcaaattattgaaatttatgaatatttaattttaccttttaagagttactaattcagaagcatgatcttttaatacatatgatatgaaatgtttacagatttactggcaaaatactgtaattatgagtcccaatggagtaaatgcttttaaaaattgtattcacttaaattagccagctgtgttctgcctttatactgttaatattatttttctcagattgttataagcaatgagctttcattaaatctttggacactagattataaatttaggaataccctgcaagatacagaaaagactaaataaataatagtatgcaaaaatcaaaattattatttaaatagacctactaaaaattaatggtgttttaatttattttaaagttgttggctcatcctttaaaatgttttaaaaaaatgtttgacattcattatcagaatgagggaaaattta

SEQ ID NO: 16507 - DNA, 1540 bp, Homo sapiens
ctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaattagctgggcgtggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagg

SEQ ID NO: 16508 - DNA, 1098 bp, Homo sapiens
tcgccgcgtcctcgcgtagaatggttgtcttggcgaccgttggccgctgccgcctccacgctctgccccgcgcccagacaccccgactccccttgatcccgccgcctgactcctcggcgtacgttctctctccggtctccccctccatgtcccctcctccccttttcttccacatcaccgatcctttctggactctctcccttcctcctttccagctgggagacaggaaaagcggtcctgtttgggaacagtaaaagcagggcaaggaaaggaaggagcggcagaaaggaggggtgagtcgaggacacaggggcagccggagaatgcggaggagccgggtcctgagcgcggtctaagcgaggctcggctctcgtccaggaactcggacgcgggctcgccggctctccgcgcgcgggaagtcgagcccaggacgccgccttcaggccggcgcgctgacccggtgccccgacccggagcctgcggtctgcctggatccgtcctaaacctcgcgggctggacccgcggcctgagtgggtgggtgtgtgccagaggattcgggactaggcccagctccgggaacctggaaatgtggcccgcttctcagtggcttcctgttcatgcgcttgggcctagtggcctagttgaagaagtggaaccacagcgtgagccgacagggccttacagatcagacgtcaagccccccagaccttacaggggaggaaagtgaggcctgcactggccgagccacccacttaaggcggtgcggtagcctagaggagcggcagacttctctttccccatcccccgccccatcacttgacgttgctgccggacctcggtacaaacccaagacaaaacggggccctttggaaaaagtgagatttagcgatcactcttacgtagccactctaaatatctatctagatatttacaaatgcacctccccggtaggtagatttcactcagaatttacccaacaccgtgctttgtgctggggccacatgccacctttctgtctagtatggctgctctttctccctcttcgcaaatatagctctttttccttcaggtctcttctgaagtaagtagcccttcctc

SEQ ID NO: 16509 - DNA, 1223 bp, Homo sapiens
tgactggccaagtggcagaacctgaactggaaaggggagtgtggtgccctttccattgctttacatttccttgtaaatgtcaagagcagctgaatgttagtattcttttcaaactgcaaagtgacttttcagcaattggggttgttgtttgaaatgtttttgaatggcttgtcttctatctttccctcataggaaaagaaaaatacgacacatagccatgattgaagacgtgtaccttcatctgagaagacatctgcaaatattctggtcactattaaactatatccaatttttaagttgtttatttttaagtgagggctgtttttatagataaagtttaaaaagtctggcattgttgacatatattttacattaacctttgcttttggaagaaccagatattcccaatgttagtgtaatcgatcgtatttttttgattgttatgtggcagttgcatgtattacgtttttaagttgtcataataacctggtgagagaagtactattattatttgacttttgtagatgagaaaattgagagacagaaaagttaagtgacttgcccaagtttatacagctagcaagtagaaaaactgagatttaaactcgggatggacttgttccagagcccatgtttttaaccacagcattatactgacccgtcttggcactgcactgatgaggtgtgtgatctttcttaggtcacctaatggttttggttttcagattcatttatgagaaggagaatgcatgggataatttattttctgagcagtattccttgtatgcttacatgcctttatttagtcctcacaagaaccctagacatagatagaattattatcatccttatgttacatatgggaaaattagaacttagagagttcaagtaactgctaaaggtgacataatcggtgtaagaactgggaatcaccgccaagatttcaatcactatgctttactgtctttcctttttaggggcttatgctgccgtcaaattctttacattgaatcctggctttttattttagagtcataatggcaatatgtttgtttcataaaacctttcatttagaattcatccaagaagtgacttagtctacttatggctgcaaatactggggagccattagcacagtgacagcaatcttaacaatgaaacattgtgctattaatattatattattatttttttgaggagtcacatgtgtagcaaacaggatg

SEQ ID NO: 16510 - DNA, 1227 bp, Homo sapiens
acttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaagggaaagaacagtgtggtgagtaggtctttatacacaattcgggggcacctgtgctcagtctaataagcagacttgctttcttgaattaaaagaagttccctgagagttttagtggaaagcagtgttacctcttagaattccaaaaggcaagttaattgaagtagaacgtgcagaaaatt

SEQ ID NO: 16511 - DNA, 1384 bp, Homo sapiens
tttgagccctctatgtggtccaggcagaatagtagacacactgatatttaatccttaaaacccctttaaatgagggccagtattatctctgctttcagaagtagacataataggatgaatcatataacagaaaaaaaaaagtgaagccaagagggagttaactacttaaagtacatgctatgctatactttctagagagatcacagatgtgtgtgaacatcctagcaattaacacaaagaaggaaccatcacattaattacacaatttattgtgtctgaggtaacccagtttcttgagagaagcgtaactattttcaaaagtgggaaagatcttttcataaagacgttgccagaaatagcaacattctcaatactcgtggtgtaaaaaccatgaatcccctggcttaatgccaaattatagccttagaagaataattgttccccaaatgggcaagaaaggttctaattgtcaagagtaacccaagtaagaacttttggaatatcaaaaggaaatgagcaaaatgtaaatagaggggatatgtactttgctgagtattaaattggaactacctggtgtgtacctggactaaatattctgttcactggctcagttgagtacctatacttttcgttttttgattgggtttaggtggttatgtcaaagttaaatggcaaaattaggaatttaacccaggtctggctggttcctttacaatacactgctttcttaagtacaaataatttaattgcaatatttaggaaaagtaggtacctttgaataatgataagaaacagtcttggttaagaatatgagttccctcttcaaaatgtaaggggtggcaaaatgtaaacactgcttcctattactgtgcaagtttttttatgtcaactttactatttcatgtttgttgtggagattacaaaatatagcttagcaaaaggaaacaatctcacttgaaggatatgttaaataatttaatgatattttaaagattttcttttttagttaaactttcctatgattctcttaatgttttttctgaatacaaaagtaataaatatttattgagtaaaacacacacaccccaaataaaaattgcctgtaaggccactatctagagaaaactattcttaacatcttgtggcatagtgactatgtatgtaaatgtattttattttattaaaaaagcgttgtatcatacatactctttgataacctgatttttaaacttatatttggtacaaagagctccacattaataaatacaatattctatcatatggatatacccatttcttattaactggcactgtttccaattttcagctatcaagcaatggtaatgacaaatctcacaagagtcttactagttccctaggaaca

SEQ ID NO: 16512 - DNA, 1616 bp, Homo sapiens
tctttccattcatttttgaatactcacagtgtgtaggctgtttgagagagttaccttatttttaaagcgaatatgatcttacagcaataaatctagtttatataaatatgaaaaattaacaaaagtttcagaaatatatgcattttttttaaagcagacacatgatttttcacattttctaaaatggttagttttgcagtgggaaaataaaatccttcaaagtcgatagtcaaaagaaattttctttattttcataagcattaatgactttttttttttaatagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaactgtgagattttcctgtgtaatttgggtagattttcaagagtgtgaacacaaatttaaaataagctataatcagcaacaacacaatgacaatgacatcttccccttaccttagccactaagaagacaagggctgttactcatataacttgcttttattacttaatgtacaccaaactgttgttgtcaattatcttttatttaacttctccaccttcattgctagatccttcgaacagcactgatacatttcaaggtcttgttttaggataactactttaaaattttttaaattatattaaatttataaaataatttataaattcatatattaaaacaatataagataatttcttgatttgtcatttataaatcctaaagtatatttgtttaatggcctatttttagatgaagaaaaagccagttggtaagctgtgttagtcatgtatcagttcagacagacgaggtctcaatttaactccaggcttagatccagtttcttttgcccttcactatttgaggtaacttcatttttcattctagttttgatatttggctgtttatttttgtcattttccattatttcaaagggaatttg

SEQ ID NO: 16513 - DNA, 1127 bp, Homo sapiens
ttcagtgtggcccagggaaggcaaaagatttgacacccctgttctagctatgtagaaacacatgctgtactatactactgggctctaagtcaatgcttcataatgtgaaaaagtcctcagtatatttaggtcttcttaataataaatttcattatcttaattgcatgtatgtttcgtttaaccagggatttcttagggtaacagtcactaatgtgtagaagtgaagatggagattgagaaaaaacccagtcatgattatttattgccctttcttttttccttgttctctatgttaacgtattcttatcaaagaaacactaaacaaacttctctttatctcatgtaattctctatagtagttcatatgaattatgtaaggttcaattttaaaacaatagattcttaagatagtatatactctaaagtttgtctagacactaaatgaaaatgagtgctttgacagtttatgtcctaggctaagtcagggtacgaatatgtatctattaattatcttgtctttccagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactggtgagtataataatgctttggtgtttttctatttgaagttttatccctttgaaagtaaaatttacatatccattttctcaagtttttattatattttgttttacctatatctgtggtttggtaatggaaacgcttttgggctatcttagttccgtaaaaattctgttacaaatttgttgtgatcagtaaaggttgatatgcttatatatgtaaaaagtaatctgttcagttattggccgggagcggtggctcacacctgtaatcccagcactttgggagggtgagacaggcagatcacttgaggccaggagttcggaccagcctggaaaacattgcaaaaccccgcctctactaaaaatacaaaaattatccaggtgtggtgatgcccaccagtaatcccagctactca

SEQ ID NO: 16514 - DNA, 1428 bp, Homo sapiens
gtgtgatagccaccccttttccatcatctgtatctagaaggatgggggaagtgtccccatgcctacttaataggagttgttggggggtggggctctaaaagctagcacacgtgggataggatcaggccattgatcaacatgttcatccttaacaccttggaaaggtccactaagcctatgatcacacaaagaagagccagtagagatttgacaaaggccatgaacaaaacaagtgtgatgccttttcttctttagttatttgcatggtttgcatcaacagtacagagtcacagggcagtggcttaacccccatgcccatatacctggatggagagtgggcacagccaagaacacaaggtggaaatcaggttgaagactgtcattttttaaaggcgaactgggcactcatgtgttcccttttctcttctacctttaggaaagaacatgaggttcccttggaaatcattcaagaggaagatggaaggggctgtttagaagagcttaaaagctacaggctgtaagactggggcctgagtgctggcagtggaaaacactgttgggctgtgatctctccctgaaaagttccaggtgccttttcgcttcctgcaaaagaaaggaagcgaaagagaagaccatgtccatagccctgaagcaggtattcaacaaggacaagaccttccgacccaagaggaaatttgaacctggcacacagaggtttgagctgcacaaacgggctcaggcatccctcaactcgggtgtggacctgaaggcggctgtgcagttgcccagtggggaggaccagaatgactgggtggcagtacatgtggtggacttcttcaatcggatcaacctcatctatggcaccatctgtgagttctgcaccgagcggacctgtcctgtgatgtcagggggccccaaatatgagtatcggtggcaggatgatctcaagtataagaagccaacagcgctgccagctccccagtacatgaaccttcttatggattggattgaggttcagatcaacaacgaggaaatatttccaacatgcgtgggtaagttcattaccagctctcagtttttttgtcacctgcacaatcttcactatgaaaatttgcagactgcctttgaatgctaggtagcacccatgcattaatcccatcactcacatacctgtagtgagtgatatataagagcctcattgaaatgaaaaaaaaaactttatggaccacttacatttattttgtggactccagtggtacacataccacatgctggggaacactgacttggtgaaatattaggtgtgattgtgttggctttcttaggactagatgtcagactcactcacttatcttgataagattattattttttggttaactgactaaagttacatggactctgatgcagttactggtatttatatct

SEQ ID NO: 16515 - DNA, 1199 bp, Homo sapiens
gtatcaaataaaataatttgaagagatcttttaattgttacaatacattggtagagaactcattcagtctctagtatgcaatgtatttcttccgatttgtatggtattgtcatcattactttgtagaagcacttcagattttaaaattgggctgctcattgtaaaattataagagcactcatttgataaataggaaaatattgagaaaataaattaaaggatcattaaatttgtattcctttgtagggtactatttttgtgtcaataaatggcaagtgtctaagactgaaaggaaatacatattatccaagggaggaaaatgttttatgtaaatatcagataaaataatacgtttctactaatagtgataaatataattgtataatacattgaacttttacaataatttatttttctagctctctccggtccgtgcctcgaagatgacaaagaaaagaaggaacaacggtcgtgccaaaaagggccgcggccacgtgcagcctattcgctgcactaactgtgcccgatgtgtgcccaaggacaaggccattaagaaattggtcattcgaaacatagtggaggccacagcagtcagggacatttctgaagcaagcgtcttcgatgcctacgtgcttcccaagctgtatgtgaagctgcattactgtgtgagttgtgcaatccacagcaaagtagtcaggaatcgatctcatgaagcccgcaaggaccgaacacccccaccccgatttagacctgctggtgctgccccacgtcccccaccaaagcccttgtaaggagctgagttcttaaagactgaaggcagactattctctggagaaaaataaaatggaaattgtacttaatattgcatgttaagtgtatctgtgccagatagggtggggattttgtgtgttagaccaagtataaagtgacacatattattttcatggggaagaaagcttattcatgtaatttcatttttttcttttttgttttctttttttttttttttttttgagacggagtctctgtcgccccggctgaagtgcagtggcgtgatctcagctcactgcaacctccgtctcccggattcaagtgattcttctgcctcagcttcctgagtagctgggattacaggtgtctgccaccacgcccggctaatttttgtatttttggtagagacggggtttcactatattgtc

SEQ ID NO: 16516 - DNA, 1155 bp, Homo sapiens
ggactgtcccaggagaccatccccagagcccaccatagtgaaccttatacccataaaaaccagggacattgtccctgaaactgatgatctagaagttggtgctctcctgggtgggtcactgtgggaagggatgcagtagaagtgaggattccagttgtccttagcatctgaggagttctagggatgtgaagagagagaatgtcatttgcagctgcgttactgttgcttttgaggggatattgccagtattttaccttttcttcaagagtaagatatgaatgttttgagtaaattcaccttacttttcttggcctctttgataaaaactagaacactagaattttctgtgcattggtgtggaactgtcctctgattcaggtccatgggccaccatcgtagagactgatctggtaacttgtttgggaaaacctgggccaatgctgactttttgtattctttgctagactttggatcttcagccccctaaatctatagtggatgcctatgtgctgctaaatttgggagattcggtaacaactgaccacatctccccagctggaaatattgcaagaaacagtcctgctgctcgctacttaactaacagagggtaagtatgaatgaggcaggaaggactaaaggcaaaaatggaggaatggagttaatgaggccagcatttctcttttcacctggccctttggaatgagactctttggttgtgcactgaggcttaaccctggggtaaaaaccaattgcattttctgtttgctgcttaacagcttccatgggagaaacgatcaacatgtgaatcctaacaaggggaaggggagagggaccttcatttgagcaagtgtatatattaggcccaactgtcatccctgcccccggcttggctgatctttaaagtacaaggctctgctcttaacctggggcagaggcagaacctgacacgcattgccaggtcctggttgagaaacctaacgtttacagagcactgcttggaggatttgcagcttactcatctgtttatcagttcttcagtagtgtgctgatattcataggtatgccagtattatcaactactgtctcatatattaatcgaggtcagtggttccccaatctgagtttccacgagaatcacgtgaggacataaaaatt

SEQ ID NO: 16517 - DNA, 1202 bp, Homo sapiens
aagttgactctaggtggggcctgtggacacattagtccctgaccttcttcaattgcatcttgaccttggtcgttttccctgtatcctttggattgtgcctgccagggccactggtgaacttcagcttcacaaattttcagcaaacatcgcttctgtttttgaataatgagtatctaccttcagaagctgggttacctggaaccttcttaatcttcttctttatgaggtgcccagtgtcctcacttgcaaccccaccctgcctgtagaggggagtcaggtgcatggatcctctggactttgggtgaatctatttttttttttcctccaattgtaaaataagtgagacccacctgttctttgcctcagattattgtggggttttcttttttttttttttaaatcacaattatgtactggttctaacgttctcttttgtgtgttattccatcccttcatctgtaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcac

SEQ ID NO: 16518 - DNA, 1168 bp, Homo sapiens
ggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaacaaatgtgtattcaacaaaagaaaaaaaataaaacagtaacactttaaaacaagaatcagacattttcctatgcagtatttttttttaaagtttattttagtaaagttaaaatcttgaaagtagctaagggcataattatgtcataaatactgaacttcaggtgaacaaatactttatagttttaattattttctttgattttgaggagtatcttatttgctttctatcatcagtaaaaacagcatttaacttgctaaataaacatgaaaaacccttgtcatacttcttttacattggtagttctttcatataaagtggttatgttttatcttgttttagggatgataaaattacatctatgctgatgtaggattgccactgaacagtggagcttgagttaaatcttaattcagccttcagtttgcctttgccttgctactgtattcattctttattcagtagaaattgcagtgcctactatgtggcaggttctgcactaagttttggggtttttttttttgttgttgttgttgtttttttttttgagttggagtctggctctgttgcctaggctggagttcag

SEQ ID NO: 16519 - DNA, 1109 bp, Homo sapiens
ttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagata

SEQ ID NO: 16520 - DNA, 1344 bp, Homo sapiens
tcacaaggtaaacagtgttccttggttttcacatttgtttcattttctgagctgttcttatatttgatttggttgtttccctgaataacagtctgacctcaaaaacctatgtacaactttgtgttccctataaagcgagccctgtgaaaagaaactggattatttggattgtagtattattgccactttgctgtgagttgtcttcttgggggacctagaaagctattatgtcagggtcagtgttttattgtgacaaaaggggacttaaaggctgccgtgagaattagtggagttcatggataagaaagctgtggacaattctttgtctcttctgccatcagttgggtgggagctttggggctgcctcctgtcaggagtggtgaattagcagggggaaccctgtgtatatgtagaagaaagcattttctggtgtgtgatgctttcttacacaccaggaaagcatttcctggtgtgtaagaacttaagcattgatggggtgttcacaatggcagctggcatttaccaagggccaaccagaggtaaagcactctgatgagctcttgacagagtaacatggattgcctagagtgtgtcctgaaggagtgtattatttcaaaggtgggttgctcatatttataatctgattaagctcattttgcctgagggaagtctaaactaagcttacggagctgtagaatacctggcctggcatactgattggagtcacgtttttgattttttttttttttttttggtatctcatattggttttccagagtagctgggatttgacttttcttccttgcctgcagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcat

SEQ ID NO: 16521 - DNA, 3447 bp, Homo sapiens
cagtggagagggaggaggaagtacgtgtgatgatttcttcttaagatttttgttttaagacaatctccttgtgctcttttccttgtaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcaccccagagtcagaactgtacacatcccaaaatttggtggccgtggaacacattcccggtgatagaattgctaaattgtcgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaactgcaggtggtttctgtttgccaggtgtaagggttgtcatggctgtgggatggggtggggacagggtcattccctggtctgtgacccatacaaatacacatgcctccctggaatcagacatttccccatctgaacttcattctcttatctgtaaaatgggaataataacacatagggacttttttgaggcttaaaagtgacgatatatgtaaaacaatgactaatgcctcacaagtactcactacatagtagctagtgccatttcaaagtagaatttttttcccctagcagttcttgggccacattctgctattttcaacagataccaggatcattcagatgtagatctcagggccatttgcaccaggtgctcacagtgtaacttgaagggaattatccaaaatgaggtttctt

SEQ ID NO: 16522 - DNA, 1216 bp, Homo sapiens
caaacctcagtcaaccatataaggaaggtagaagtgaaaagtcccataggtacccaactaatgtcaccagtttcctggatacctttcctggagtttatttatagtgtgtataaataaatgatgtatgtgtttaaatgcctttttcacctttccttttagagctgcctctttttaacagttccattccattgtatggatgtactatgatttattgaaccagttccctactgattattctgttttttgcagtcttttgttatgatgaacattccacagtgacaatgttgttcatagtcattcacacacatgcaagtccttctgcaggatatatttctagaggggaattgctgactcagaggttttggtactctgtgttgattgtagagtgacggcagaaaagtgaggcccaagagtttcctagtgaccatgtgtagtggacaagtcaccagtccctgtgagtgtttggcccaaaggctttaaggcatttgatatcactgtttttgtttctgcaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcaggtaagagatactcagtcagaatctgtggtaaacatgtctctctcatgtgttgactaggaaatgcagtcctggcagctcaagagtgcctctttaagctctggagcagaatgcctcctctgagaaatgggtgctttgtattagttgagatggaaagaagagaccagaaatgcctgtagtctctgcacatccagacaaaaacaaattttccccccttttttttttttgtttgttttttgagacagggtctggctctgtcacccaggctggagtgcagtgccgtgatcttggctcaccgcaacctctgcctcccgggttcatgccatcctgtcacctcagcctcctgagtagctgggactacaaacacttgccaccatgcgcagctaatttttgtatattttgtagagatggggttttgctgtattgcccagtctggtctcgaactcctgagctcaagcaatccatctgccttggcctctcgaagtgctggattataggcatgtggcaccatgcctg

SEQ ID NO: 16523 - DNA, 1194 bp, Homo sapiens
gaggaggaagaggaggcgcggctcaacgcgaccgaagctccgccgcaaaggctcgggaggaagagggcggtgcgcggccaagcgtcggagctgcagtcatactccggggaccccacgacggcgccccgcccgctgcccaccctcccgaggccccgcccagcgcgcccatcccgccacgggctgccccgccttcccgccctcgtccagaaaaccccgcgcccggccccgcccccgccttcgccggggccccgcccctcccctctccgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttggtaaggactcgggtcggcgccagtcggaggattgggacccccccggatttccccgacagggtcccccagacattccctcaggctggctcttctacgacagccagcctccctcttctggatcagagttttaaatcccagacagaggcttgggactggatgggagagaaggtttgcgaggtgggtccctggggagtcctgttggaggcgtggggccgggaccgcacagggaagtcccgaggcccctctagccccagaaccagagaaggccttggagacttccctgctgtggcccgaggctcaggaagttttggagtttgggtctgc

SEQ ID NO: 16524 - DNA, 1157 bp, Homo sapiens
ccctgtaattatatttgaatttaaactatttagggagggaactcactggagagcaggtagggctgacacattacacaattccaggaggcagtattcatgcacacagtgcttcctgcgattgtgcagttgctgtgcagtggccctgaggcaaagctccctgcctttaccaccttttaggggattgctggcctagagcatggtcagaatgctggtcctatgctccctccctccccttaccttggaacccaggccagtggcccatctccattcatgcacaatctgttttgagtctcagccatgggttccccagaatgggtaagcaaggagccttgtgtgggcagtggtcggctacccctggatgggcccttactgccccgtgtgtattttctaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctccttctgtctctgtggttgtactgtccagcaatccaccttttctggagagggccacctctgcccaaattttcccagctgtttggacctctgggtgctttctttgggctggtgagagctctaatttgccttgggccagtttcaggtttataggccccctcagtcttcagatacatgagggcttctttgctcttgtgatcgtgtagtcccatagctgtaaaaccagaatcaccaggaggttgcacctagtcaggaatattgggaatggcctagaacaaggtgtttggcacataagtagaccacttatccctcattgtgacctaattccagagcatctggctgggttgttgggttctagactttgtcctcacctcccagtgaccctgactagccacaggccatgagataccagggggccgttccttggatggagcctgtggttgatgcaaggcttccttgtccccaagcaagtcttcagaaggtta

SEQ ID NO: 16525 - DNA, 1388 bp, Homo sapiens
ctctttctccctctttcactctctttcccctgtggaggagcccccttttggccctttctagttctcttcttgattcatcacttcctcctttacctttcatgaaaaagcttgttctcatcttatgactgcgattttggttttgattgattaaatacttggaaatgagttttaactattaaatgtttgtaatcctttttttttttatcaaatagaaaaatagtggcactaaacattgcttcctttttacaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaaggatataattttaataatatcacttcagcttaaaacctctactgcggaaaccaaatttaatagaattttaatgtcatttcagcctataactccactacagaaaccaaattaaccagtagcattgtgaggaaagagcaaggaacaatctgggcttgggccctgggtctaccatttactaactactgagtagtctattcaacctctctaaccttctgtttccttattagtaaaatcatgcttaactcacagagcttttgtgaggaataattgaggtaatggtcataagtaccttgttaactgcaaggggctattcttatatgagggattgttaacaataaaaaagaaactgcttcattcttttcttggaaggtgcctggagtactacagcaagttcaaactcctgcccaatttcagggtctttaatgatcctgtcctcc

SEQ ID NO: 16526 - DNA, 1391 bp, Homo sapiens
ctgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaactttatagggctgccttttggtgttttcatttttttatttcttttcattttttttcctcaatcctcctcctcctgtagcagggctgtcctttggtccttacccagtctgcttcaaaagggatcaggtacagcagcaggaacaggtgactggagggaagtgacacaaaacaaaaccacctctctctggacccatgtagtgcaggtcagtggccccacacacaacaggaagcccatgagcatctgttacctctttcaagcagtgggttcagtgggtgaatagtacgtgtgagagtatctcagaatcagcaaaaggcaggagacctgacttc

SEQ ID NO: 16527 - DNA, 1744 bp, Homo sapiens
agctcaccctgttctccccactccccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgtgagtacagcccccacccagctcaccccagcctgcctctcctctgccctgccccccatgtccctgactatgagtgtctgtccccccaggaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaacctccagttgtgcaaatatctttctgcttgctctgctgcttttctggggccagttaaggagcttccgcatgcccacactgacccagggtgcccggctgagtgtctgatctggtcaggttaccctgggggtcatacagagaggttagagagcctcttcaccaaggctctcagtttgaactcagtggtcccaaactttcccccaagtttccgtcctcatgggtacccccagcataatgaatggaatcttcttcccaatccctgtacccacacatcaccccagaaaggcttgagccctatgcagggaagatcttgctgcagagctacccaatggggagaactgctgcccaggaggtggtg

SEQ ID NO: 16528 - DNA, 2163 bp, Homo sapiens
ggggccctcatccctgatgcccgtgctgggctatgatcctcctcagctctatctgacgcagctcagggttggtcctaaacagctgaatgacctggggaggggacttccaggtgaagctgaggctgtggaggagctcttaaatgcctgcctataatcttctctgttctgtccctttctaggaggcctttggggatctggcccttttcttctatgaccagcatggtggagaggtgattggtgtcctctggaagcccaccagcttccagccgcagcccttcaaggtgtgctggctggtgacagctgtgttcctgagtgtgtgcacgtggttctgtgtgggcatgcatgtctgtgtgtagtctgtcctatgggcaaacccgtgtcaggtgcggagtgtatgggcttgtgtttctatccccaccacccccactctgtacccagcttggtgtctctgggtgtgccgctgtgacactcaacccacatctcttctctgatttccccaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggcttatgcttgtaatcccaacacttagggagtcaggagaatcacttgagctcaggagttctagaccaatctgggcaacagagagaccccatctcttttaaataaaaagttaaattgcttaatttcccccgtattcctggcctgtctgcccctttcacataattttaacctggtttcttgtatgtaaactccttgagggcaagaacatgtttgaacatagacttcttcgtgtccttcctagcacctattacagtgctttgctcaggggccatccagcacaggcagatggggggcagagaagcccactggaagattgcagagtaaagggaatccatttgtgaaatctgcctgcaagaagtgggtggtgacggtgaaagagaaagcctaagagattatagagttgacgtttattgagggcttaat

SEQ ID NO: 16529 - DNA, 1195 bp, Homo sapiens
cttttggagctttgctctccagatatgagaactgggcctagtgttgctaaccgtggctcaggcacttctgtcagcagaggagccctggctctctcaccttggtttcaccttggcccacagctccacaagcacttatgtgcctggccttctcttctcccctggcccctccaggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggtgagaggcacacattgggctgagggcatagcatgggatggtaaatctggaggagaaggcacagaggcacggaggcctcaagtatggggggacaggatggggagccctctggctccaagggctcctgcagagtctcagcactcactgtctctggcaggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtgagcaggccctggtgttgaggtggagctggagggaagaggtgtggggacttttcctctcatggcttcccttttcatcccacaggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaaggtgagttgggggtggcgcagcctccctacctgagcgcctgtgtgatgggcaggctctgacctcagcctctccctgtctctttcagggccagggtgggtttactgggttccttgtctccatgctggttgtcttccttgtgtctacacgcaagatccataccaccatgagtggctaccaggtcctgagaagtgtcttgcagtttctgggtgaggcaactaggtggggaaaggccaggggctccactcctcctgggaatcctctcatcccagtagcagtcttttggtgttttgccatcagacagatgagcaaactga

SEQ ID NO: 16530 - DNA, 1935 bp, Homo sapiens
tattatctattcttattctggcagttatccctgtgcttcacacatgcaaacaacaaagcatgacattccgcccactaagtcaatacctgttctgattcttaagtcgccgacctattggcccttacatgaatcggaggacagccagttgacgaggtgattctggctataattgatccactgctttaaactcccttgatattaacagtgtatttcccctcctaaaaagtcaaagtttacttcaaaattgtacccagtgggttgaaagcatttggtgtagtacagggtatctgtcagatgctttcaggcaggtactgaagtttggagagctgagtcataagtaatattgattatttaaggccaattataaatctgtcttaaaaaaagacttaccgtaaaccatttctgtgtcaacctcccttcaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctcctgctgactccccttatggatctcagtttgctcctttttatggacctttaatggagagagagtaaccctccacagaatgtctgaattcttgcattctttacccttccatcactatattgattctttttttaaaaaatatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctg

SEQ ID NO: 16531 - DNA, 1252 bp, Homo sapiens
ggcctcgggagcggcccctggctatgcacccccaccattcctacacatcttgccagcccaccagcagccccactcacagctgctgcaccaccaccttccgcaggatgcacaggtgagtacagtgatggaggcagccaccctactctgggccaggggttctgctccagccttgacagccttcccttctcctcttcctcagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgcatggtctctgtgtggtgtgactgaagggcagctcagggcagaagccctggacttcacagggctaaaggagatcccacatggtcatagtcttctgacacaggctataaaggcttgaaatggttttcctttttactggaccctcttg

SEQ ID NO: 16532 - DNA, 1144 bp, Homo sapiens
tgacctcatgatctgcctgcctcggcctcgtgaattgctgggattacaggcgtgagccaccgcacccggccacacaattgtttctttaagatttattatttacagctgacttttgcttttaggcatagcctgtttcttgacacattttaaattgggctattggcaggtaaaatcttggctgggtgcaatgttgttttggggttcaaatagcaactgcaagtagtaagaggcagatagcacttcatgtacagtgactacatgtagtgataaaatggttgctggttaaaattggtggtacttgagatttttgtttagaattgctaagctcgtaaaccatagacttagattgcagtagtcgaattggtttaacagataccagcaaaatgtaaaatcctcaagggctacttcttgagaatttgtattccagagagcttttatcttttattgtaagtgtccttgttttctctgaagtacatgcttatcttttactatgattgttttgcttaccatccctactttcttgcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggtaagtttttgtggaactctttttttttttttccttttttttcttttattattatacttgaagttttagggtatgtggaactcttgtttgccttgtttagaattaaggaaattaagggagagcatatgatttaatgttttcctttgtaggaaactttaggattttggaccctttgtttaaacagtaggtgatggccgggtgcggtggctcacgcctgtaatcccagcactttgggaggccgaggtgggtggatcacttgaggtcaggagtttgagactagcctggccaacattgtgaaaccctgcctctattaagaaaatacaaaaattagctgggcgtggtggtgtgcgcctgtaatcctagcttctcgggaggctaaggcaggagaatcgcttgaactcaggaggcagaggttgcagtgagcccagatcacgccactgccctccagcctgggtgacaaagcgagactccttcctaa

SEQ ID NO: 16533 - DNA, 2682 bp, Homo sapiens
tcccttcctcccccttttcctgccccatggctagaggtgctaattgtagtctctttctcttcccgtagaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccatggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgcacaatggtgtgagtgagtattgtgtagccaggagcctgccaaaaaggccccacatgactagttggaaggttggcttgagctgttgggattgcttgtggcagaaggggaacacaagccattacctccaggttagaggcaggtcaagtgcaggcacaaatactaagacctgcttgctctgggtccccaactctagcccaagatgagttgctctgaggtccagctgagggtggatatgcccagggtactgaagtagtgtgacgttacttctgttacataagtaagggttggtaataggccctgtctgcttggatggtgccctgagaatgacgctgaaagtgcttgcatagtactctgggaataggatattaatttttgttttttgtagttggaaccatagaccttcactgccctttgtaaggggaagacacagtgaccacagtgagtgatgctcttctagagcctatttggagctgtagctgagagaaactgccaa

SEQ ID NO: 16534 - DNA, 1099 bp, Homo sapiens
ccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtaagtcttttaaatcccccgccgactcccatattttcctgatgacagggattatgttttttcttgttgtttggttgatttttttcgagacagggtctcattctgttgcccaggctggaatgcagtggtgtgatcgtaccttattgtagcctcgacctcccgggctcaagcctgttgggacaacaggcacatgccatcac

SEQ ID NO: 16535 - DNA, 1215 bp, Homo sapiens
ctctttgaagagcagccatttctgggttcagtatccttccttggtgggaagatggatgtgggtggtgggacccagacagagctcagcaacagtgagctgggactgggctgactcctgaaggttgatggccgtcaccaaacccgtttgccttggcttccaccacagcccacctctgcttgctaggggaccttatggagactcacggggctctgggggaaggatgtagacattctgctctcccccagtccccgtcccacacacacactccttcactcagctgtgctgtgaccccacccttttctttaatctgtgttctcttctctcccttagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatg

SEQ ID NO: 16536 - DNA, 1337 bp, Homo sapiens
tgcccccaccctcacccacgcttctgctcattggtctcaatcccagcctggaagcagggagtaaggctggactccaatggcccattcccctcaccccagcccaagacgtgggaggctgcttcccagtaagaatccaggagcaagctttggtgaatccagtgggctgagtggctctatggatgtggttgtttggatgtggtagggagtgcttagcagaatgtgtgtgtatctctgaggctgtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaactgccagctccaaaatattggggtacagctcaccaccccccactccgccaacccattcctacctcctctagtgcagggacccaagttagatgatgagaaaatgccaaacaaagggaggcaaggacagagaaggtac

SEQ ID NO: 16537 - DNA, 1132 bp, Homo sapiens
cgcctggcaatggggggagtccatccggtgaccttctttggatttcagttccctgcctcggagttggagtagtaaccttgcttcgaggtcacttgccttgaggcccccctgatccttcattgtccaggccagactgagcctacctgagcctcggcgtgcccacagcaacccaaaccctgaagtgcgcaacacactattacagatcaacccgcacacacaattacagctgagacgcagttagtggtgctcattatcccccaccctgacctgatggcggcagggcttccccagggttggccttctacaatctaaactgctgtaattctgcagggataaatagaggctttccaaaactcacacctccttcccccaggttctgccctcagctgggcatggggtgaggggaggggtacagggcaacccggaacattgctgggactggcaagacggttcttgggtcttgggtcctaagccagattcttaaactgggtaacaggggttcctgacctggagcctgtcgctgtgtctgtttgttaccgacggcggctgtcagacttcagggctgccagtattgctgtggactagtatcattctgtgagactgttactgagtctatcaacattgctgtgtcactgtgttgatgtcaccgtcagtgtgactcgatgtgactgagtctcattgcatctttgattctgaggttaccatcactgtgactgtgtcagtgtcaactggtatcattgccccgtttgttggtgtcaatgtatgtgactgtcactcactgcattattgtcatcgtggtgactgtcaacatccctgtgtgtcattgtcaacggtacaactgtgtcattttcaatgggtgttgttatcattgtgtaatggtatctttatgccacagtgggacaatggcagtaagttggggccccagaatttgactcttaatgtgttacctgtgtgggagtaatgatgacactagggttctgtgctgggagaggtgcagggacccttgtgctgacaaggggctcaggggcttttgggcgctaggctccttccttgcttatggggtaccccctctgttccctcctcattctggggctgacctctttgaggggctgagaggaatcctgggctaatt

SEQ ID NO: 16538 - DNA, 1239 bp, Homo sapiens
cacccgctttggcctcccaaagtgctgggattacaagcgtgagccaccgcgcccggccacatccttgccttttttccctttgctgctccttttctgctttgccttggccttaaactctcagggtcgggggcatgagaagagaaatgaaggttgcatcagtagcagggggtgctgcgggaactagagcaggattatgggcagtagtgaactctgaagaattgaatcagttggatctcccatggatcttgagattttctccaatgtgtccagcagcctgggtgtccagtcatgaggaaagcagaaggttggggttcttctgggctcacattgtagtagaatgggcccagcaatgtaaggatgttgcagtgatacttaactgagaccaggcaggagggattgagaaggagagggaattggaggactgaagcccttgataagggcttagaggaggggtgaggtgaccacagggccagcaggcagttttcaaaactgtaaatactgcatcctttgctttcaaagataggttagctctgagtgatgtggaggaccctgggggaggggtaggtgatggggattcagaggagattaggagagaaaacctcagtggctgccgagcaggtctctcaaatgcacagggtcgtgaagcatctaaaacactcctaaaggcaattatggctgcagtggcagtgactcaggtgtcttgctgccagcaactgactgacttcccccattctccttgcagctaattcaggaattttgttccctctcagcttctgcataccgctttttctctgaacatcttcacttgtgtgtcttctgccatcagcagttctctgagtatcattggaactccagagctttgaggccaggccaccttgcagactattgacctttggctgatgatctcatcccatctgctgatggccagggtggagggatcacatataataattatggtgatctgtgctgaaggtggcattgcgagctctggagtcccaggaggggcattttctctccatctttggtctctacggggcccagctggggcctacaggaggaatggcagggaggggaccagaggcatgagccctttggagtcagaaaggctgaccagctttacaagagagcacaagagttgtgtctagttctgtccactttctccttaattcactgcaatgtggcttctgccaccataaggtcacgtcttggcacaaaaggtaaggaagtagagacagctct

SEQ ID NO: 16539 - DNA, 1187 bp, Homo sapiens
cgtcatcttttttaggctccatggggagtgggagtccgtgatgaggcaggaagtttagtggaagatgtgggctttgcccagttcctttctgtgctacactttggccctacaggaccagtgtgtggaaatcactgaggagtccaaggctctcctggaggaatacaacaagactgtatcctttctgctcaactaggaccctaatgggtgctgtccctaagccctgtccttttgttccacctctagctctctctcatcctatcctacccacctatgtttgcctgttccccactttccatgaacttcctcactcagattcctattctcaccttgacctacaaccagacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgactggaggagtgtgctggcttcttggtctaggatggaggtggtagggggcagaggtgtcagcctgcctaatcgtttgactgggaactaaactcatcctggtctggctttctggcaggtgtagagctctcaaaatgaaggctctcatttgattatgtgaataggatattcctttatgtatccatttatcccacatttaccaataagagacctccaaatgtcagatgatgggagtagatagggctaatccctgccctgcacgggctagcaggatagacagtaaaggaaaagggcagtcctatcaggtggacacagaagaaaaaagggactgaagggacctggtaagtgatatccagggactttcagagccaagggagcagcatgtgcaaaggcctttaaatttctctcttgggagcctacctgctgccacgagccgagaagggcagcctaagaggtttggatgcaggaagttttggtcctggggaggggaagttgggaagtaggggcgctggggcaagcatgttgag

SEQ ID NO: 16540 - DNA, 2075 bp, Homo sapiens
cagtatatttgaggttgggtgtatgcatcgcaggcatggtggttgaacagctacacttttcagataaagcctcacaagtcctggaactacccctttcctagctacaagcccagcccaggtttagctaaatttctgcttgattcgagtgaggcttgggagtgcagacttccatacagtgggtccatggccaagcgaggtagccgtccatggcttctccaaagagaggacgtgggtcagatgatgccacagaacatttaggagtggccatctgggccagcccagtgaggtagggctttttgtttttctgaagctccctctccattccccacccctagttagtccatgggccagggaagcagcagccatggaagggcagggcagagctggcttttcacttgggtgctccctgtcccccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatagacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttccatctttttgtgtgtctgagcagccggaaaaagcctctgacccctggggacctcaggaagatctctctcttgctgtgtgattcatggtagattttttttttttttttttaagagatggggtctcctctgttgcccaggctggagtgcagtggcacagtgacatgatcatagctccctgcagccttgaactcatggtcccaaacaattttcctgccttagccttatgagtagctgggaccttatgagtagcaaatgccaccatgcctggttagctttttaaattttttttagaaatggggtcttgctatgttgccccggctgatctccagctcctggcctcaagtgatccttcctcagtctccagagtagctgagataacagaaacaagccaccatgcctgacaagacagtggcttttgactagtagggactatatacttgagtgtgccttagaatcacctaagacactctttgagtcagtaactcagactactgagctccattgccagagatcaacatgttca

SEQ ID NO: 16541 - DNA, 1176 bp, Homo sapiens
ccctgcatctgcaggctgggccacggggagtagttccctcttagaactgtcctccacccacagggatagtgaacctccttctgggtcatatcccaccaagctttttggtcccctagggtgggccttccctactcccttgtagcctgtccagtctttgaagcccaccaggtaactggtggtatggggcagtgagtgcttctagcctatccttgtcggtaggtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcaggtttgtgaggtcgccccttcccctggatgggcagggagggggtgatgaagctttggttctggggagtaacatttctgtttccacagggtgtggtcaggagggagttgacttggtgtcttttggctaacagagctccgtatccctatctgatagatctttgaaaacaaaggtgccatgatgggctgttctaacccccacccccactgccaggtaagggtgtcaggggctccagtgggtttcttggctgagtctgagccagcactgtggacatgggaacaggattaatggatgggacagaggaaatatgccaatgatgtggaggcttggaggtaaaggacctgcctgttcttctctgcttttgccccttgacaggtatgggccagcagtttcctgccagatattgcccagcgtgaggagcgatctcagcaggcctataagagtcagcatggagagcccctgctaatggagtacagccgccaggagctac

SEQ ID NO: 16542 - DNA, 1234 bp, Homo sapiens
aggtgagctacaataggctgaactatgtattgatttgcctgagggcaaggaatagaggctgtttttctttaagagggttgaaatattcttagtgctggctgctcaactgcacagtaagtcacttgattttctttctgaggtctgagagacctagtgttattttttttttctctctctctctcttgagacagggtctggctctgttgcccaggttggagggcagtggtacagtcatggctcactgtaaccttgaaacctgggcttaagcaattctcctacttcagcctcctgagtagctgggactataggcatgcgtcaccacatctggctaattttttattttttgtagagacaaagtctcagtatgttgcccatgctggtttcggatttctggcctcaagtgatcctcccaccttggcctcccaaagtgctgggaatacaggtgtgagccaccacgtttgcctagagacatctagttttgttagtgcttgaatcaatccattcctcctacaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggcaggtgcaagatcatgggctgtgggagacttgcatgagtcctcaggctggtacggagtgctctttagtttctggacaagattccactggggttagggttggtctaaagggaaggtagaatttttgaggatatcaagataatctagaatcaggaataaaatggggtggccaaagaaggggcaaactgtagttgggagtgctcgggtagcccaaagatctgcgtatctcgagaggagaggctaaatgctaaggtacctctgctgctgcttttaggatgtggacttggagttcctggctaaaatgactaatggcttctctggagctgacctgacagagatttgccagcgtgcttgcaagctggccatccgtgaatccatcgagagtgagattaggcgagaacgagagaggcaga

SEQ ID NO: 16543 - DNA, 1587 bp, Homo sapiens
atcctgttctggcagactcatggcgaggtggagcggcgcattgtatcacagttgttgaccctcatggatggcctaaagcagagggcacatgtgattgttatggcagcaaccaacagacccaacagcattgacccagctctacggcgatttggtaaggactccagatacttttgaccccgtccttgcttaggtcctacttctctccttcatctaagtcacctaatcctcttgaagcccttcacagtgattgggtccaggggtctttttcctttaccctacgtcctgtctagagtgaccaaccaccctggttttcctgagactgaaaggtttcccagagcttgagacttttttagtgctggcattaggacaatcctgtgctggctgagatggttggtcaccctaggcctgtctcttacctctggactagagatgagccctgtttatgtttgtgtactgtcccacaggtcgctttgacagggaggtagatattggaattcctgatgctacaggacgcttagagattcttcagatccataccaagaacatgaagctggcagatgatgtggacctggaacaggtgaagtgatgatgatggctgaccaggcgttacagtgtctctaggcagttgctgggaactggctagagacataaggttaagatgtgaggagatgggttttgatttctggacaggggaaaggaagtaatctgagattgaatccaggaaatgggagttggcatttttcatagttgacgctgcatttagagtaaatcagaattgttggagcagccttatttctaggtcccaagtccagaattaagtacttaaaacccagcccataaaggtattgatagtatatattcaaggaaatgagaggacccagggatagcagtcaggggaaggattctattgtctctgagcctcctgcagcagctgggtctttgaggcagcatagtaagtagatctttctctgcaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccgggtaaggaccacacccgtgcctcaggtacacacatacgtgctttgacccctcccttgataagtctcatccccagttttccctccttttctagtgggccttgagccagagtaacccatcagcactgcgggaaaccgtggtagaggtgccacaggtaacctgggaagacatcgggggcctagaggatgtcaaacgtgagctacaggagctggtccaggtagggcaacttggtccagggtgagtcactgtctcagtacattgtaattgatctgggtgatctcagggtgtcaacacatttgctgcaagagttgtgagagcacgacttaggaacctactgttcttaggtttgaggcactaaggagtcttcttctagagaacctggatctgataccattgggtacaccatgaaataatggaggggatgcttctgtttagttaggtttctttcaaa

SEQ ID NO: 16544 - DNA, 2190 bp, Homo sapiens
acacacacatgcaaaccctgcacacatattcatatgtcttaccctctttttttcctccatccttcctttgctccatctctccccttctctgttccaggagagtaagctatctttatggatctctgaaggagaaagtggtccattttggctgggtcagggtccagagtgcacagttctaccattggtggttgtagtgaaaacttgggctacctatatggcagaagtcagaacttgatgggcttctgacatgtcaggttttgttcactgacctcttgtcagagggactcttcacagtttacctttctcatcttgcctgctgcttattaagacaggtggggtggagttggggagaggtagggcaatatctaatgaagggcactatctaatgagcttggcattttgaccccagggtctgatgagttctcactttgtcttgtagttgacacctctaactgtgcttgtactgtttgctctcgcaggagacatttttcttgtccgtggtgggatgcgtgctgtggagttcaaagtggtggaaacagatcctagcccttattgcattgttgctccagacacagtgatccactgcgaaggggagcctatcaaacgagaggtgagttttctccctgattccagtatccgattttatgattactcagtgtggcatcatgtggtaactgtcaggactgggtgctcggccggctgcggtggctgacacctgtaatcccagtactttgggagactgagatgggcagatcacttgaggtcaggtgttcaagaccagcctgggcaacatggtgaaatcccatctctactaaaaatacaaaaattagccaggcatggtggtacacatctgtaatcccagctactcaggaggctgaggcaggagaatcggttgaacccaggagtcggaggttgcagtgagctgagattgtgccactgcactccagcctgggtgacagagtgagactctgtctcaaaaaagaaaaagactgggtgttctttggagaactaaccatctttcagggatgagaaacctgccagctattcatttctgggcctaattgtttcttggatttacctaatgccaggaatttcaaaaaactagactgaacccaaaatatataagtgattgaaatcatttttgaagtaaagctgatggtggcttcaggcctctgcccattcccagggtttccagcttcagattttagagaccccttctcagtaagactacgagtaatgtgagaggcaaggactgtgctagaaatctttgccttgggatttttgtagttgttctttgaggccggatccctttagaggagaatcttttttaaatttaatttaatttttaatgagatggagtcttgctgtattgcccaggaactcctggactcaagcattcctcccacctctgcctcccaaagtgctgggattacagatgtgagccaccatgccgggttgagaatcttcttatacggtaggtttttgcacactaggtagtggaatgatttagagaaactcagcttttgctgatataatattcttgccttctcctttctttatctcctccatattcaggatgaggaagagtccttgaatgaagtagggtatgatgacattggtggctgcaggaagcagctagctcagataaaggagatggtggaactgcccctgagacatcctgccctctttaaggcaattggtgtgaaggtgagcatcctgggctctggaatcaagtctaaagtggtgccaatgtctaatcctgtcccaatgtctaatcctgggactgttttcatgcatggctttcattattgccttggattagaggggcaataacgtatcctttagtttacctaaggctctaaattcattagagctgatggtctaaaaccagagtaggctaatcaaattgtctgttgtgtgcgtgtgcgcacaaaacacacacacatatatatatgggtttttctttacaactcttagaatataaaagccattcttgtatcaatggaccctgtaaaaacaaatctcaccatagtttgccagcctgtctagagcaatgtcacccagtagaagtaaggaagttaaggaaattttcagagtgttaaagggttctgagtctaaaacatttgagaactattggtctagagtgtagcttctcaatcttttcctagtgggaaagtgtttccatggaac

SEQ ID NO: 16545 - DNA, 1326 bp, Homo sapiens
ggagggaggatacaggcgagtcagccgagctggggcctgggacccgtgcgcagtcccagccctcctccagcagccctagctggtacctgggtgtgcccggaggtcgggattggcgcggtctcctaggaccccggacagcgcagacacaagcagcagccccaccacacccaagagcgaaactgcgcccgccattgccggcccacgggtggagggatcgggcgggcggtgccgaagcggtccggcattggccggccgccccaacgcgcacgcgcacgcgagcaggccggccggctccggggaggccacgcccactccccgtagggcggggccagaccatatttgcataagatagtgtcattctagctttcctgtatttgttcatttcgtgtctattagctattctgctagccacaatgcctctgaaagcctatagtcttagaaagttatgcccgaaaacggtttttttaatctcacgccaccaactttctcaccctaatcataaaacacaatttctttagggctataaaatactactctgtgaagctgaggacgtggttcgtgctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcggctgttttttgttcccgagaccacggctcactgcagcctcgacctccccgggctcacgcgatgcctcacctcaggctcccaagtagttgggaccgcaggcgcacgccatcatgcctggctaatttttgtattttttgtagagacggattttcacctgttgcccaggctggtctcgaacgcctggtgtcaagcgatcagtccacctcgccctcccaaagtgctgggattacaggcgtgacaccgcgcccggtcaacgcggctgcttttcatgcgcgggcagctttacgctgttcttggccttgctatgaagtccttgtgctcattactccaaatatggagcattcctgaaacagcctcctcttctacctccctctccctttggcaaacgccatagtagccaccattcactgtgtagctggtacacaacatatggactctgcttgggctagaatcctgcctcctgtactcaagagcggtgaccttgtgaaacttagttctctctccgtgcct

SEQ ID NO: 16546 - DNA, 1175 bp, Homo sapiens
ggtatttggtatggacagaagagcagttctttgtagccagagggtcctattgcaggtcaccatcagggctaatgtccacttcctccccaggccttgcacactcagatgctcactgcagtccaagagatctcccatctcattgagccgctggccaatgctgcccgggctgaagcctcccagctgggacacaaggtacctatggagactcatgggaagtcccagggagtagggtgagagagaggggacctgacccctagtccaaccccttgcctcaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaaggtattgagggttgggagggaggagctgttactagcaggaggctggagaaacaggaacaacagagctcctctcctctccccacagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccaggttagagtcttggggtgcctttggacactgaggctaccctgggccagagcctccaagcacagtggcagagaccctaacagtctttccctttccctatcctcccccctcagctagatgaaggaccaatgggtgaaccagaaggttccttcgtggattaccaaacaactatggtgcggacagccaaggccattgcagtgaccgttcaggagatggtgagtttgggcgagtcccagaggactgccctcggagagctgactttggatataacttcactcgttccattatcaccaggttaccaagtcaaacaccagcccagaggagctgggccctcttgctaaccagctgaccagtgactatggccgtctggcctcggaggccaagcctgcagcggtggctgctgaaaatgaagaggtaaacgtggaggcaactctgccctgccccctgccccttgttcctgatgtgtcagtgtctagggctgtcccacccccaccctct

SEQ ID NO: 16547 - DNA, 1112 bp, Homo sapiens
agtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcgagggcccccaggtggtccccagatctcttccctgacctggagagaaggaagcattccacctt

SEQ ID NO: 16548 - DNA, 1130 bp, Homo sapiens
cagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttc

SEQ ID NO: 16549 - DNA, 1212 bp, Homo sapiens
agggcagtggcattgtggattatttcttgtctttctcttttcttttttcttcttttcttttctttgagatgggatcttgctacattgcccaggctggtctcgaactcctgggctcaagctaccctcccaccttggcctcccagagtgctaggattacaggcatgagccacaacacatggccaattatttcttttctggtttgatttccattaatgctgctatatttatgtaataaactaaaactataataaaatgttactttggataagaacagaaggacaaagagaaagtaaatgccctctgaggccacgctacttttaggatatacgtggaatttgtctggcttgatgttgaaaacgttctgtggttttatattaagggaaccttgtttctcctcacagattgaagcctgcaataaagaagcagagaagattgagtcccttatcaactctgacagcccgactttggcgtcccatgtccctctctctgccctcatcatttcccaggtacaggtctccagcagtgtgccatcggccggtgtcagggccaggccttcttgccactccctcctccttcccctcagcttgggccttgccttgcacttgctctggacatataactgactgcccacggaaagtgcagaatgctcctccacctcactctcctgccttgaaaaagacattcaggactgctggtttgtagttgaatattggccaaggaaaggcacatgtcacctctattcgccacacagtatttttttttttaatccgccaatattagtaggatttttgttttgtttttacaaatgttaaaatgtgttgttccaaatactaatgaaaacagaatgtctcttcctggtagaccactgccatatgatttacatttcctcaccataagggtcccccactctaaagcaaatttatcgctgggaaatgagatgaccactttttagaaagataattcactgtactatcaggttcacaaacttcatttcagagttctttttgaagtatttaaggttcccgttgcatttgttttgtttacagataattacctactctggctagaagctaggggtcccagtgaagagccactgccattaaagaatatgaaacatagataaaacatctttgaaattatgtaaattatgtaaattatcaggcaaatttgcattaaattacagaaatttaattcagaaccccaactactgtg

SEQ ID NO: 16550 - DNA, 2093 bp, Homo sapiens
ctaattcagccgtgtccctctccctctgcccgttcccctacaggacacttcacggccatggtatggaagaacaccaagaagatgggcgtggggaaggcgtccgcaagtgacgggtcctcctttgtggtggccagatacttcccagcggggaatgttgtcaatgagggcttcttcgaagaaaacgtcctgccgccgaagaagtaacttgttaaatgtaatgggaaggtggcagacttaagaacgtggatatgaagtgcctagaaccaccacaacctggctgtgcgtctgtccctgtgggtgtatgtgcttgtgtgtgtgatgcatgtgagcgtctctggcacacacacttggacatacagttctgtgtgcgctcattcttattacaggagtgagcaaaggaagcatttaccccgatggttacctagaccacgattatttggattggggggaggggggatccgttttttttttttaattttttgttatttctaagcaaacctcttttgtacttttcttacttctaatatccatccctggactttttgtattccaaatgtttgtgatgctgagaagtgaagttcattttatgtgatcttcatgcgtcgtaatctacttttggtagataattaagattattaaaccctcatttaaatgtgacataaaatacagctttaagcacataaatacaaagcagcttccatcaggaacatggagcaggcagggactccattttacagaattactgagatttctcagttgtaaaacatgatgtcatcctgcatgcctcctggaattctccaatggggtcgccaaacaacaaatggagaaaaaaagttttacttccttgcattcttctacctttaaatagcaaagtaccactaccaccaccacctcttgcccccttccctcttttcttaaacttctggcatttcagagctcagcaggctacccctggtttctggagagttgggctaggcctgaagctccccctcccccacctctgctaggcagcccaggcctggtctgggagacagcccctcaccctgcctgggctcttggccaagcggccttggatggatgaagtcagagaggtggggtgagggtgagcttactcagggcccccagaggaagccctcagcctctgccctccccccacacagggcgggagcccaggcctgttcctggcagctgtggctgcagctgtgctcctgctccctcctggaatgtgcgacaagcccaaatgttccggggaggcggccggggcagggggcttagaagtgctaatatggttctgtgttttgcctgaaacgataccaggttcccctgaatagcaactttacaaggtccatgtgggagggaccaacccagatgccctgctgagtgtccctgaaaccatggcagctccatctgtcaagatggcaggggccggagtgagggggctgctggcttaacagcaggcatctgggcaggccagtcctcaaagcagctcctgaaggtctgtgttgcactgtcaccagtctcaagctatgcctctaatttcaccagggatattgactaagaagacaataaaatctttttctttgtgtaataacctcctccaatgtgattcatacttcattctccatggctgagacaatccgtgactctgaatccctctctcgattaaccccagaatacctgcaacccattccccgtggactgtgttgcttaagtggccaagttttaagccatctgacccaccagcacagagctgattggactagagtggacactggatccaacggcagccaatcaccaggctggccatggactgggaatttcagctaagaattatggagagaatttaccagtggaactgaaaaaaataaggatgccataaattggaattagggccatggcaaaccaaagctacttgcaagccaagttatgaataggaaatacacagaagcgaagaagccagttattggaggtacaaaagaggaggagatgctgagaatattcttgaatgttcctgagttttctagctccagcccaaatctgtatatctttaaaatatgcccctcattttcctcagggcttccaaacaaactgat

SEQ ID NO: 16551 - DNA, 1228 bp, Homo sapiens
ggggtggccgtccctggtcagtccagctccagcagacggggtgggtaggacgctccctatcaggcagcacttccgcctcccggggcccgcgcagctcacctccctcacctcccgccctaccccagtcacgagttgttttagggggaccgcccctccacttgctgattgggtagctcctgaaccattgttgtcctctgattggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccgggtgagagtgcgggcgcgtttggggcgagaggacttgtctggaaactcggtccacagtgggtccgagagcttctgtgtgactcgtgctccttgctgaattaggaggttagggagcagtgcaaacaggaaacgagaccctggcccggtctttcagaaacctaggctcgagaagcctgttcggttctcagcatgtttgagtgcttctgggcgcgggcggagcgagaaagcaagtgtagggtggcaggctccggagccggaagaagcccgttcaattcagcaacttttcattaagcatttgctgtgcctttagtccggtctctgaagcaaccgcattggcgcagtttttccagacttataagcttataagtctgagccgagcacagaactcgttattagaaaaggagggcggaaaaaaataagaatggaaatatcgtttttgagagatacaaacaaaagtagcaatgcagttcagcatttaagcacttaaggtgtacagagtgttggattacgaggaggaaggagggagtagggaactcgaaagatgatctaggtctggagaaagaactgccaagcgcggtaggagtttgctatcgttgagcgattgatttacagcta

SEQ ID NO: 16552 - DNA, 1232 bp, Homo sapiens
taatgctccacaggagcagagacagacagagagacatagtgagccttgaaccaaacacctgtattccaacattttacacagcggtctgggcaccctgtgcctaggagagccagctacgtgtctacctgagtctgacctgggccaggggctgttatcttgggaaagccagaatgtcattaagaaagggacaaataggcagttgcttgtgtagcaaggcagccaccaggttgctcaaagggggttctgcataaaccaacatattttgttgttgcttccagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtattatgtgaagcttctttattgacctcaagatgtgttgtagtttggagtgaggttggaaggaatttccaggaggaatttccttgaaatttctagggctgaggaggcacagccactgggcacacagccctgccttgaactaagatagcaccgggatctagagtgggatcctgtggacattttcatttgagaagggagtttagtggctgaaggttaaccccctcattatctacctaagacacagctgtgaatcctctcaccaacctagtcgttttctcccagatgggctcttgcttgccagtgtccctcagtttagggtcttggatagtatatttcggcaggagtctgtggggcacgtagactctagtaagaccttgactcctttggatccggccagtaagcctgagtcaggacggcattcatgtgtggctagccccattactgttgagtcctgtagcacatgttgggttctgtgccatcccaagcacttggttcatatt

SEQ ID NO: 16553 - DNA, 2403 bp, Homo sapiens
atacaaaaattagccaggcatggtggtgggcacctgtaatctcagctgctcgggaggctgagacgggagaatcgcttgaacccaggaggcagtggttgcagtgagttgagatcgtgccattgcactccagcctgggcaacaagagcgaaactccatctcaaaaaaaaaattcctgggctaattcggaggtttatgggttaaaaaaaggcaaaaattgctttgtacctcttcagaggaagaaagaatgtaaaaactgtgggaagtaaaagtagttccattgctttgaatgtgtttcattgtatgtgtcacaatttaaacaagttttcctttttgttttgtaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcac

SEQ ID NO: 16554 - DNA, 1156 bp, Homo sapiens
gcatttatttcttagtgtgtgattttgtcctgacttccacttattctttattgagcttggttgcatccattgagaagaatgttaaatttcatcccaggtatgggtagtttttgtaagttctctagatgatcataacatgcaatcaagattgagagtcactgccctagttctaggattggtcctgctgaagactccatgggtatgctgtgagaatttgcagtgcagaggtgacttgaggctattacagcaagaatgctgacttgaccagtgcttgcagtttgagtatattgccactagatgatgcctttgtttgtttagataaaagttgagaatttagtgcaaatctgttatccaaatggttctataactaacaattagttacattttgagaaacaatccgctttccttttaaaagaaggaaaaagcccatatgcacttctaaatttataactgttatatatttccttaatttgcattccatggttatgtattggtgttctccagcataacttctctttgaggtgactttgaactttctggctctgctgtctgcagcagatctcctgtgtggctgcctgttggaagcttcctctggagttctctaatcatggtactcacaatctctaaaatgagctgtctacactcattaagaatgttgaaattgcagacttgtctcgggctttggtaatcccataactgtttcctgccctgatcagaattagctaggtgcaaagggaagcagattttgcccctttggcagaaagtctgattctttctgattcttctctccttcccttggctctttagaaactataagtggaaccttttttctgggaaccaaatgctagaaggcaggtttttttttttttttttgattgacaaacatataaagaaaaaacatactttgaacagataaactggtttaagttgttctccatgggaggcagtggagaaggtttgtgacagaccctgtgagccttcatttatggctgccacggattacacacatagacaccatctaaggaaagtggggttgcctgggagaggattgcctcagccttcttccaaggagcacactcctgggcatgttgtttcagttgtaaatgacatctcacaattcacaaatcctttgccagctgtaagaactctatacagc

SEQ ID NO: 16555 - DNA, 1113 bp, Homo sapiens
cccacctaagcctcccaagtacctgggcctacaggcacatgcctggctaatttctattttttgtagagatggggtttcaccgtgttgcccagactggctccaacgcctgagcttaagtgatccacctgtgtcagccttccaaagtgctgggattacaggcatgagccaccatggggacggcctttttctgtttagatttgtttagatacataaatacttattgttgtgttagagccacctactgtattcagtacagtaacgtgctacacaggtttgtagtgtaggagcaacaggctataacgtacagcctaggtgtggcctaggtgtgtagtaggctctgacgtctcagtttgtgtaagtacattttatgatgttcacacagtgataaaattgcctaatacatttctcagaatgtgtctctgtcgttaagtgacgcgtgactgtattttaaatattgaatcatagtactgtcatctttaagttcttctgtctttcattgagtagtcaaataattggagtctggaagatgtgaccgcaagtgataaaaattatgtggcgggattaatagactatgattggtgtgaagatgatttatcaacaggtgctgctactccccgaacatcacaggttcgtcattcttattactatttaaggcagaatctattgtttcaattataaaaacaaccagactaatgtgaaaccaaggtgtgcttgcaaatttaatgaatgcttaagccactgaaaatgtttatgagcgataactggaatacgaatgaaagggaagtcaattatatccaagttgaagaaagccaagattctattttagagctctttactgctcctttatttcctgtttattattattattttttgagactgagtcttgctctgttggccaggctggagtgcagtggcacgatctcggctcactgcaacctctgcctcccaggttcaagtgattctcatgcctcctgagtagctgggattacaggtgcctgctgcctctcctggctaatttttgtatttttagtagagacagggtttcaccatgttggcagctggtctcgaactcctgacctcaggtgatccacccacctcagccttccaaagtgc

SEQ ID NO: 16556 - DNA, 1321 bp, Homo sapiens
gtaagagacccaaaataggtgtccagctcttccggttctctagttcagtgttttcccatatcctctgcctttcaaatgagtttttaaaggtgaaaaatgcccatttgtttcctctagagttttgttccttttacagttaaaataaatcgctagagtaaagccttgtcatttgaaagagaattggatttatactttatggccctaaggggcaaactatctggagaaaaggttttatgtagtataagaatgaaatttacaataatagctgaatgacagtggaatgggctgctttggaaggcaactagtcccttttgctgggctgtacaggcacatgcttgaccatcacttggagttattttcaaaaacatgttgaataaacctgataattctataatgtagcctatgggctaatagatttgaaaactaattttagatttgtttttctttcagctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaagttgggtttctatttttcttatcctactttttgctgcaaaccaacaatcactagtgagacttgtattatattgagattattgcaagcttcagtaagttcatcttgttttggactagagaatttgccaatcctgatgaagtgtcattgtgttttattgccaggcagtcttaatgaaaggtagcattactgcttgatgctgagtatatgaaatattaatactaccaaaggaaaaagtactatatttttaagccaaatagttctccaagtttgttgagtggaggggggatagtccttaaccttctccccaggagcaactacatacacctctttttagctgattttattggtatt

SEQ ID NO: 16557 - DNA, 1160 bp, Homo sapiens
attgtttgattttgctttgaataatttgcatgccggagttccttcctttctctgtaaatctgtaattctctagggtagtgcgacctaatataactttctacagtgatgctgttttgtatctgcactgattagtatggtagccactagctgttgagcacttgaaatgtggctaatgcaactcaggaaattaattttaaatacctaattttaatttaaatgtaagtttaaacaattggctatctaccatattggacagtgcaatcctagtgttctctggccttgagatggctcctcgtctgtgatttcctgattggtgaaagggaatgatacatgtgttcctttttttccccaagactcaactccaaagtgactgtgggaatcctatagtgcagtcagtcccttagccacagaactgtaggtggctggcattgatgcctgtgagaaagaaccaatagtagcacctgtagtttgctgagaggaaatgaactggtttttaatatcattgtaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagtaagtcctgatgtctgctggcttgactgctttttataattatacattcttggaaagttggttaatcttcaggattcagattctttgtaacgtttgaatttctcctcagagttagaaatcagtatccattttaacacatttggaaactcatgaatttaatcctatcttcttggaaacatatcaaattcagatgtgtttggctgtgtagtttctggtgggctgatacttcatgccttaagctcttactctgtattcatatcttccttcccaggcctgttgcttatttgacttagcccaaatgtgaaaactggcctttcccctgttctgagtcacttgaatacagatgcagtctgcagttgtataaaattatcaattttttctaattatgggggtcacacgcagcttagattgtgatgttcaaggttatgtagacattcacagaaggcttctgacacttggtcatactgaggcatactgaggttcatgctgaggcagattct

SEQ ID NO: 16558 - DNA, 1133 bp, Homo sapiens
tccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggagg

SEQ ID NO: 16559 - DNA, 1118 bp, Homo sapiens
aaaaatacctaccaagtactgtggtcatattgacattcaaaagaagtttcataaatcgtatcaactctggaaagagttcatgtcagatgctagaccagcaagttacccaactcaaaattcagccaatgattctttactatagagtacctatcatgtgtcaaataatatacagacttcactactaaccctcacaaaaacttgcagggtaggtggaatgagccccaatttaatttggaggtaatagtgggtcagaaagattaaatgacttgccttaagtcatagagttagcagtgagtggcagcactgggattcaaacccaggtttgtgtcttgtccaaagcctgtgcttactgctttaccattgtgctctttagtttgtaaagtatggtaagctggcctgttatttgtttagtatcttctggattttttttttttaattatagagctagcttaccgtgtgtatcatgtaaaaaaaattcataagattaacaatttccatgagaatatcataaactcagggcacacattctggccattcctgactaaaaaacttcaagcagaataagcagctataaaatagaaaagaaaaattaaggataaacggcattgtgaaaaaaaaccgagccacacagatgagaattaaaaattaacagccagcaaactcaaaagaacctttgtcctccttgagatatggtgatgatcaaaaagttagcaaggaatattaatcaaggaattaaagggcattaggaatgctatagtattggaagaaattacatcttaacatttcaaagccccatttcacttaagagtaaaatctaatctgatgttttttactctgaattttattcagtaatttttattcataattcatgataattggtaatgtagtataattgttagtaaatgcagtacaaattgttctactgttttaaaaagttttccgcagaacagtgcatttatggcaatgctatgtttaatgagttagggacatcaaatatatagtagttccttattttcagttgtgaaaatgaaatggctaaagcagaagagacgtctattttagtcttttaaaaatgtgtgtgggtggtcttttttcctcagaagcccaaagcacatgta

SEQ ID NO: 16560 - DNA, 1441 bp, Homo sapiens
gattttaaaatttttaaaatatctgctaagtaatttgctatgtcttctcccacactatcaatatgcctgcttctaacaggctccccactttcttctaatgtgctgttatgagctttggacatgagataaccgtgcctgttcagagtgtctacagtaagagctggacaaactctggggggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagaaaaaagaagagtacaggaaaaaaattcagatagacataagagtattttggatgccattaaactttgtcaataaccattaaaacataggcttaaattatcacgtattgttacaaagacacagttttgtctcattataaaataagattatatgaaatttatattctagaaatgattccaaatcatgtcctaagaatttctcccattcaaatgataatggaaattactgtcaaaaggaaaatctcaaagttaccattacgctgctctcttgtaaatgaactagggataaagatatgggttttatcaaaagccctaaggaatatatctcacattcacctcctatatgtatgtgtatatataaatgccactataaatgaaaatgtcacccagagataataaaataatttttaaagtttaaatctggtccaaagtctttaaaataggtagattttcagctttcttaagtttctccctcatttagatttcatggtttttacataaagggtgaatatttgaattttcttttaaatttcactgcatcttcaattgcccaactgtgtttcctgataaattttagattcacatttttaggaaatttggagtattccagacaatatactagatacccagaaacttttctcagtaggttctgaggtgttttaagttcttatgctagactgtaagctccttgagggcagagactgttttatttattcttgtatcctcagtgcctggtacaggacttgacacagagtagttgttcaataaatatttgttgaatgaatcaaatgaaccttcaccatatatggcctgaagctctcatgaagccagcagaatgcagtgtgcagattattccgtaatagaggaatccatcatttattattataattaacagactatattcatcagggtaagatctgttctgaccataagcaagcaaacatttctcattgacttggaaaactgcaagttaagactcagtttttcattcaacgaacatttgaatccctattatatgcc

SEQ ID NO: 16561 - DNA, 1262 bp, Homo sapiens
atgcctgtgatcccggctacccaggaggctgaggcaggagaatcgcttgaacctgggaggcggaggttgcagtgagccgagattgcgccactgcactccagcctgggcaacagagtgaaactctgtctcaaaaaaaaaaattgaaaaggcaaatgtgattgaatatctgaaaagctttaaaagtggcctttctgttacgtctgtggcacaaatggctcatgagcgcaggacacttatggtcttgtgtcctatacttcatgtgtgatgccaccagaaatgttatggattccgtattgaacacactgagagtggtatgagccctcaggactgcaccacagagtaaacacaaccttgatatggtggcgaatatgtgtgtctttcttgtttcatttgtggttggggacaaaatcgatgtatttgtctaaatagtcgatattcatcttaacatggttggttgtgtaatcaccagctatattgtgaactgtgcaataaaacagaagcgtttgtgtatataattacctttggatacctgaaattcccaagcttggttacaatgtaatgctcagtataaggctgtgcaaacatgtaagggaataatggtggtcgatgggatatatgaaatgggatctagagggcttcgagtgaagccaatcatgttgaacgaacactggttcagtgtagatgaagtagagtgaggcgtatgcagtcataaaatgaagggtggacaggagattacatttgaagaaaggataagcactcagacttggtctcttttaaattaaaatatttcttttctcatgtgcaaatgtatatcaaagacttgaacaggtattctcttgaaatttgaggatttttagtttttaatgctgtctttgcttaatattaaatatgtgttgcctattggctcccaaattgtgtgggagtctctaaatgtttcctcttgaaggttcattattgaaagtggttaagtgcacaatgctatttttgtttgatagtttgagttttatgaccctatgagtttaaatgaaatctgttaaatgtttcagagttaacactttttttttgataatttggaataaagtttgttttttaagcccactctttttggtcttctcttatgcttgagtagttgcttgttactggcacgttccttttttgtggtagtgatagattgatctgttagtctttttattcagaaaacatttagcacactaccttgacttttagcaacttaacctggggatgttgcaggtaaaacattc

SEQ ID NO: 16562 - DNA, 2247 bp, Homo sapiens
ctttcttaattggccaaatataagttggtgtcgtaactccaggccacagtgagttatgggcaaagcttttttccttaagcatcaacaaaataggataaaaggttccaataggaaaatacaaggttttttttttttttttttttttttttatcattacctaagagctttaggctaattgcctggtaaatagctgtccatctgatggcctttgacagggaacctaatccccaagataggattctttttcttaaaccaatcttgaaatcgcctgcattgaaacataagtggctgtgaccggccagaggagaaggtcctcaggggccaggggctcctcaggcttcctttgttactccattgcttgcttctctgccctcaggagcagctgcagaggacagtcttcattaagctcaagcatatgacaaaggggcagaacagaaaagaaaaacagcttattaggtataggcttttcatgataaattgcttgtattagttttgaaactaagcacctattggataggcattatactatttctatttagatatggtagatcaaggagctatgaaagttcctgttttgctttctaggtttgaaagttttctgtttgattctgactgtgatcttcaacccttccaaaatgtccttgtgttataatttcacttatttcattgccaaaagatgaagggacttgaatcttgttatagttgttccatcctgttaacaagttttcattttgtgtgtggatcaaattctggttagcttggtttctttgaattactggtgccatctcagcaaaggcctgtggttatttttccccttgagtgggagttggtcatattcaagcatcctgttctcttaaaactctccttttaaaaaataaacacttccataacattttgttttggaagtctattaatgcaatcccacttttttccccctagtttctaaatgttaaagagaggggaaaaaaggctcaggatagttttcacctcacagtgttagctgtcttttattttactcttggaaatagagactccattagggttttgacattttgggaacccagttttaccattgtgtcagtaaaacaataagatagtttgagagcatatgatctaaataaagacatttgaagggttagtttgaattctaaaagtaggtaatagccaaatagcattctcatcccttaacagacaaaaacttatttgtcaaaagaattagaaaaggtgaaaatattttttccagatgaaacttgtgccacttccaattgactaatgaaatacaagagacagactgaaaaagtggattatgcatcttaaaaccctttctgtaaatattatgtagctaaagattgatttccagcatctgacatgacagtaggtttcttgttaaccagtttttcttctttctggataattgcatatgaatatttatacatactgaccaaaataaaggcctcaacttggtagtttactgaaagttcttggacaaatagtccataaaagctgttgacctctaaatgcactatggctggttaaatacagtgaccatccttcttccagctgtaaaggatgaagcgtattaagcattagccaggcagtaataaagctaaatagccatacagcagctctgacaatgttgtgctggatattgcagtttgctttcaaggtgcagatgtaaggatttaaaaaaataataatttggcaccaaataaatatgagtagcatccattggcctattaaatcgagtcaggatttgaagggaattgagtttgagaaatgaataaataaaggcaccttggtgcctgaccccctcaatcatgcgtgtgactttgagcactcacaggtgtgtgcagctactcagcccagggcaggtgggttagcctggggttataccttggccctgggaatagacaccattgggcctttggttttgttgggcttccttttgtctttacactccacacaggtggtagaaatctgagttctaaagcacttttgtgaaatacaagctaagtgagaattctaaagaaaatgctttggtttctgctgtctcaaataagtggcatttaaaaacaattattaataaatatttttaatggttttaactcagtatttttttttatttctttgtcactctttacagcttttgaagaccaaactgcaaatacattaccagggatggttttgtgttgtcctatagacttcttaaatttgacaaaaaatttagcagaacttgtaaccaacagc

SEQ ID NO: 16563 - DNA, 1202 bp, Homo sapiens
ggcctctggtctccttggggaggctcttgttggttcttttaaatgaatgtgtgagctggtgggaactgggaactgcatggcccagtcttttccttgtacagatgaggactgaaagtccaaagagggcaaggaactgccctagagggaaagaccccagcctgtttatgaagcaaggggtcagaagctctgcgtgttctgggtgggcatcaggacacacctggagcatcatgttcacatctgggctctgcctcttaagcctgagattcatgagtggatggaggcagggctgtcattaggcctgcgagcatgtgagccttgtgagcaagcctggcccaggaagagcagagacgcggcactgggggttggtggggtgggtaaaacccagacaggggtctgtctctctgtcgttctcacctccccgctggcagctctgagtttgtggtgtttctgggtgggaatgcaggtgaggaagtgcagtatccatttcatctctgcttccttcctttttgcctgcagaatttcagaggcaggaaagtgtccggtcccagcataaaggtatccagttatatgacaccccttacgaacctgaaggccaaagtgttgactcagactcggagagcacagtcagcccccgactgcgggagagcaagctgccccaggatgacgacaggcccgccgatgagtacgaccagccttgggagtggaaccgggtcaccatcccagccctggcaggtaaggagccctgaccctgctcaggaggcagctgctgagctgcgctcagcactcaccttggtccccacctgcgctcaggacaaactccagggttgtttaataatccagttgggtggtcttttttctcagtaccctcacagatgtaggctgcagaggaaagggagaggtgagggtagggaaaccaggccgaggagaaattctgggtctggcttccagggtctcagtgttccagcctccacactttaaagagagggctcagatgctctcattgtctggttctgtcttggtcctatttattgataataccctagctcactgaagccaagagttcagtttttggtttatttatttatttatttatttttgagacagagtttcgctcttgttgcccaggctggagtgcagtgatgcgatctcggctcaccgcaacctccatctcccaggttcaagtgattctcctgcctcagcct

SEQ ID NO: 16564 - DNA, 1221 bp, Homo sapiens
gagaggcttgagtactgtattagctgttgctacataacaaatcaccccaaaaccgcccgtggtttgattgtgggccatgctgtctctattgtagctcttcagctctgccactgtagcttgaaagcagccatagacaatatggaaattaatgggaacagctgtatcccaataaaactttatttacaaaaacaggcagctggcctgtgcgctctagcttccaacccctgctttaaacgataaggttttattatagccaagagcctgcatatctgagtcatttttctagtctcagttgggctcactcatgcctttgcagtcactgggggtggggtgggtatgcagccctgctgatcctggctaggctttcttacgtgtttggtgggctggtttaggatggccttgggctgcaacaattcagctctgttccgtgtggtctctcctcctccagcacatgttcatatgacggcagcagggttccaagaaaaagcaggagcgcataaggtctcttgaggttggaaactggcatggtgacccttctgctgcattctgttgactaaagcaaatcataaggccagccacaattcaaggagagaggaggagctgcagtgtcccatggcaaagggcagggatacaggcaagccattaattagggccttcgatgccatcatctaccttatccccatattccggataaagaaactgaggcttagagaggttgatgacttgcctaatgtcacacagctgcaaagtgatagagcaaggatcacaccagtgcagtcttgagttcaaaacctatatgcttcctctattttccgtggtttcaatggaaataagtagtatgaggcttggatatttactggaatatatgttacatgtctcctcctcccctttacttaatgctactcttcttgcatccctctgctgtaatttctccgctttcagcctttgctttggtgtccctagaagaggccctagagctggcttttctgtttctctgtctcccatctgcctcagagttccagaaatgagatgttaatgcagcacttgagttattttatagagaaattctgagcacagagttggcacatcccaagggacagctgcacaaaacgtgagtcttgtaactgtcatgtcttctcattctaacaccaagcattccttcccttcaaggatttgccgggctgtgtgtgctctgtttggaggaagagactggcggtacat

SEQ ID NO: 16565 - DNA, 1105 bp, Homo sapiens
atacagattgcaggcccccctcctggagtttctgattgcgtagatctggggcgggggctcaagaatctgtgtctctaacgagtgcccacccaggtcatgctgctgctgctgctctgggaatcccgctttgagaaccagtgctttggaggcctttggaagtgcaggtctggaacttgcatgacggaaggggccgggcttgaggctggtctgggcatcctgtgtgtgcaggggcttggtggagctgtggaagtgggtaccagccaaagcagggcgcatagacaagtgctgaggacgaattgaggaatactgtggggaggggtggctgcgaggaagaacagagctgagagataaggaagaaatggacagagggttatgaggagacctgggtgagtgaagacccacaaactcctatgtaaaggttcaggagagtgaggacatgtatgggtattggtgtcaggggagggactgagtggtcacccggatggtaggtgttgtagctgtgcaggcctggcctttccaccattctttcaggaagggcagcatccccgggcagtgggatgtgctgcttgtggccacagagtcacatgtggactttcctgtaagaaagggaattcttttagtctttctggccgtagtcccagggatcatgactaagttctctccctctttctgcctgtcactgataattaacgtaaaaccaggatgagttttgcaaaccagaagcaagatttctttgtgcgaggagtgactgtcatctctaaaactggagtttgtgtccttgtgtgtatttgcctgctcagcttaatagctttaggcatgcagtcatcttagcataacttgatataagccgattctgagagtgggtgctgacatatggaagtgtttttgacagtccacgttgtgaaggtcaggaggtttgctacaggaaagaaatccaagaagggcagtggcccactggtgttgggtcctctgagagtgagctgtgttctactcttcccactcacgtcacaaagtcgagagaaacatcccctaatttgattgtatatttcattttaaaggaatcctcattgcgtctgaggatgtaaaatatttctcttgggtttcg

SEQ ID NO: 16566 - DNA, 1267 bp, Homo sapiens
ctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttcaaaataatatagcttaaattgcatgttaattgtatatcttacctattttgtttttatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaatgagtgttaagtgtgattttgtttttacttttggtgctttaaacttgagtctagtctaccaagctttccattttatttgctttgatggtggtaggggggtggaggtgtgaactgttgtctaaatgaaaccaataattttatgacctacatttgtagaaagaataaaaatgccactatgtctagaacataaa

SEQ ID NO: 16567 - DNA, 1180 bp, Homo sapiens
ttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtt

SEQ ID NO: 16568 - DNA, 1200 bp, Homo sapiens
tggcagtacggtgttttccagattctacttgtgccctgcacattgtgaggactcattaaatatttattaaattaatgaatgactaacaggaagagaaagattgtttgtgagtgttaagaatgagtgatgattgagaaattgatggattagtgcaatggattgggaatgaatgatgctttctagtttcgtaatacttgggaagagctattgcatatagagtaagttgatttagactttttttttcttcatttcattaccttgtttaaacttgttaaatcccagccaagaaatgcagctctgtaattgtcaattaactgtattataatatatattaaaaatttgtagagctaaagaacccacttgcattaagaacaccactttctgttcatttgtgatactagaggacagatcctgcatacagagccgaaactgcttttaatcatctgaagaaattctttgatttcagtgacttactgatctgtacctgtgcacatatcattttatgcttctccttttttccccgcaacttgaactgtgactctttcagatatttcttaaatctgtatgagtcattttttaagcttagggatttgatatgtattaatgtcccctttgtcttctgtagattttagcattttattacctcttaagaaactctgggcccagactttcagtcatatttcttattcctatggtacagttctcacttaaaggcttaattattagtagggttaaatatatacaggttatctctaaaagtacttaaatttttaaataagggcttatgtgatacaagatacggaaacaaaagtttttggatttttatgcagtagtttgcaggaaagcaaatacatagtagatcgtatgccacttaggtatgttcaggtcatgccagtttattcttgttgggccacacacacatgtatgtgtgtgtaaaaggaatttttagtattgaagcaaacaaattgtcagtttaataattttctcttacatagcacaagatggcagataccacctactgtacaacaatctaataatccctaccttagttcccctgagttatagaagatgctaaagatttagttgtaaagggaagtaacatgattttttttttctaaaaagctgttttaagctaactattattttgctactggaaaattatattttaaaacttacagatatttaaagtatgctagaaaa

SEQ ID NO: 16569 - DNA, 1101 bp, Homo sapiens
tacttgatagaggccacagattaagcctctaaaggaactgttcattccccttatttctgaatcacttgtcttctaggatatcaatgagatttgtcttggttttgttttatatttataacttatagcagaaataagactgtcacatatttctagttttatattacggttaccatagagtaccatctccaagtcattgtcatctcagtaaatgcttatgaaaaaccttaggactgtattctttctcacaaacaaacctgtaagctggagttataaggctttctttgtccaaatatcctggaacatcatctctactgtttttcctccttcctctgtataacttggttatgaaatgggcagtgaattgaatactgtatgttttgaaattgcaaacttttttttctggaaaagcttgactttgtaatgtgattttctttattctcttccttcccctctctatcgcaggcggcatattttctaccttcagcatcacttaaatggtaggtttcctcacagcatgacccagttgtcacctgcagacagccctggggggactttgagtgacttgcaccttatcccagcaggctcccagctgtctcaagcaatggaagtagatggactgaatgactctagcaagcaaggctattcccaggaaaccaaacgcctgaagcggacgccagttccagactccctaggcctagaaatggagcacaggttcattgatcaagtattgtccacctgtcggaacgtggagcaagccaggtttgccagtgcatacaggaaatggctggttactttgagtcaatgaaagaggtgaattagtcctacaaggttccccttttagtgcaatattgctttcttttattatttacatagttgcatgaactgtttactattattggctaaccatatgttcttcgtctttaggttgaaagtccatagtaaatctttcattttatttattttgttaataactggcattcctgtggggataaaataatcgtatagttccttcctgctgaacagcgagtcttaaattttctgtttaacttctcaccctttgtatttctatatgtggggcttctcatttggttttcctgattg

SEQ ID NO: 16570 - DNA, 1134 bp, Homo sapiens
gttaataaaatgaaacctttgggttgagatatatcttcagttttgtaattaaaaatctgcttagattgtttgaaatattaaaatatgaataaccattaagcattataatttaaaagaaatatgaatgtaaaattcacagattcaaggtaagccgtggcgtctcctataaaatttgttttaaagttattttgtgtagtatctttgatatagtgtccagtgttttgtaattattaaaaaagaacaaggtatcaaacttcactttcttcagcagacttttgaaaaaagtatatgaaattatattctttagttatgcattactgccttttcatttcttctattggtattctttctaaagttgtttattaaaaacctataaaaaaacattaaatttgtaaggttagctagtttttaaaggaatttgaggaagctcatagataatgtaaagcaaggaaaagtggttttgtatctctccttaataatttcatctctttataattcagaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggtgagttaatataattactttttaagaaatttcaaacctattaattgcttttagtaacatcaatttctacacctcagttccttgggtatagcaaacttaatagtgcatgaatacaaggaataaatttggcaggtagagaagctagaaggagattttcatttctagaagtattttggatcataatactagaggattcttcaagtctcttacacctaaaatgctagaaataatgtaatatgtctttttttttaaatgcatcacttggcttgtggaacagtgaagtaaacttacaaagggcagaaacaaaatccagtcatatgttgcttaatgatgggaatatattctgagaaaatgcatcattagacaattttgtcattgtgtgaacataatagagaatatttacacctagatgggttagcctactatccacttaggctatatggtgtagcctattgctcctagactacactcctgtagagcatgttactgtac

SEQ ID NO: 16571 - DNA, 3108 bp, Homo sapiens
aggcctgccctcatgaacttgtttaacatcagttgcctctttaaaggccttaacttcaaatgcagtcattttctgtggtgctgggggttaaggcttcaacatagggattttggggagggggacacataataatcatctccgagggatttatcctttgagtcgtagggactattgaccatgaccgcccttcggaatttttttcatgttctttgagctgtatcctttctgattcctttctcttaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggagaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggaggggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactaggaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatag

SEQ ID NO: 16572 - DNA, 1181 bp, Homo sapiens
taaacatctgccccaaagtatgctgcatccaaaaaatatataacaaaacgaattcttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcg

SEQ ID NO: 16573 - DNA, 1197 bp, Homo sapiens
ggcagctggtctactggtcctgaaattttgagtcacagaagacttagtgaaggagttaaaaaaaaaaatacacttgcggccgggcgtggtggctcaagcctacaatcccagcactttgggaggctgaggtgggcagatcacgaggtcaggagatcgagaccatcctggctaacacggtgaaaacctgtctctactaaaaatacaaaaaattagccaggcatggtggcgggcgcctgtagtcccagctactcaggaggctgaggcaggagaatggcatgaacccgggaggtggtgcttgcagtgagccgagatcacaccacagcattccaggctgggcgacagagcgagactccatctcaaaaaaacaaacaaacaaacaaaaaaaactcttgcttgagctccatcccagatctactgaaatggaaaatactaatatagagggccagaattctgtaattttaaaaatcactttgtgtggtctggtgcaggtatagaaactgtggcttaagtggaagcttccaagtgcatgggagaggggacatcctgtggatttgctgaggggtctgatgtgcagtttcagtacacagaccgtgggactaaaactgcaaccttcttaaagacaagtgagtcgataagagatggactgggcagagatgttgggaaaccctggactttgtttttgccagcgagtccctgagcttaagtgtggaagctggaaagaatgctgaatggaatgaagctcagtgccaaatagctgggtaaccttgagaaagtcaccccccgtttcttggtctcagtttcctcatctgtaaaatgagggtatggacttgttgatctctaaattgcttctgtgatactcggtatttattaaatgtccttttcaatgtgaagatggtataatttgaaagctgctcatcatcttaattttttgaaatgctttctatggacccagtgcttgtccacctgaacctgttttcagccatgggcctccccaagctatgcccagccactgagtcagtgtgattacccatagaactcaaatcattccaagatgattctctgcatctcaggctggaagagcaacctctgagaaggtgaggtttggaagaaaaggtggtttggcttggagggagttaagtatcctacaagacatctctgctctgggtgagggtaattctatctgctgcctggtgcttc

SEQ ID NO: 16574 - DNA, 1245 bp, Homo sapiens
aatcagcactaatgagtcagagtgtatcatgtgcctggcctggtgccagccactgtaatagcctctcaacaaatgttaattgacttccctttccctagaaatgtcagaagaaacccatgaaacccaagacatagcttttgtaacacacttggtagttaatagagaattcaggcatccctgtattcaatataatctgcttaagtacgactgccatacattttgcaaaaagcagtgacattttcagcagttggctatcttatgtagactcctgatagggttgataatcttaaatccacaggaaagaatccagtcttttagtgcatgacctgtttgatagtggtgtcccccgccctgtatattcaattacttgctgtagaatagaaccgcatgcaccatatatagttccttcggtgcttgaacattatgttcctcaggtggcacgagtgactttgaagtacttgtcagcaaccggctttcttgtaacagtactgtaaccattcagttcatagtgacattttacttctgaagctcttgttcagaatattaaaaagggcacatagcagacttcatccctttgcttcaaggcctgtgattctgtaaagctagcccatcaactcaggagagagtcactggccccagtgaatgtttaaaactgttttcaatttggttcagtggtgttaagttgatcagtaaatataactattgaatcttatcatggggggtttgattcccctttgcgctttatcacaaatggtgagctggattgattgaactgaactattttgccaggatgtctgagatcactcagaccactttctttgtgagtgcgtcatggtgcttttgtatccaaaaaaaaaaaaaaaaaaaaagactggtgtctctcttagatgcaaacttgagaagggaggtgttgaagtttgctagactccacctggattagcaaaatatttgtaaattctaaatcataggttaaggcctctgggttcttcttgttcttcatagcaatgatagcttattatgtccaaaactggtgcccaagggcatgggacaagatctactggtgtttgccaaaaggagtccttcacgttgactgttcagacaccctaagtgcccgatgtcctaacttggtctttggtctgaagacagagtgagcagagcagagggagatgtcgtgaaaccctgtaagggatgatcaatggggacctgcagcactctctgcctggctttagtttgtgaggacttggg

SEQ ID NO: 16575 - DNA, 2092 bp, Homo sapiens
tgatgtaaggaagtgcagagttttttaatagctgcctttgttttgctcacctccgactcacctcctatattctcttgctggaatgtagctataaaaattgattttttttctttttcttttttttttttttttttagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttgtatattgatgaatgagatcttacctattaaatatattattggattatggttcctgaaggtcattagagtgtgtgtgtgtgtgtgtgtgtgtgtgtgtgttttatgacttaaatatctttacgtgtgttttttagagcttggttctttaaagatttggagaagatatgtaaattaccaaggc

SEQ ID NO: 16576 - DNA, 2435 bp, Homo sapiens
acataaaacattttgctgtcattttagtaggagactaggagaaagaatatagtgagtgcagaaagtgaaattagcgcatacttgaaatggttcttaaattttctcttcttctggacacctaagtttctctgtgccaaaagtcaacattgtagaaaggtacagtagagtgacaagagcattgagtgattccagcaaaaccatcaaaacaagtgcatgaaaataacttcctcagataatcttaaggtagggagtatgtaaaaggcaatttttgaatcttactggaaattcaggagacattcttaccttctgaactgattcatacaattctcatatttgaattatctgtctgatatagcacaagaatatgttcctttacatagttaatttattgcatttttcccccttcctttttccctgcagcattgacaaaatctctaagataacctctccagtattaataattcatgggactgaagatgaagtcattgacttttcacatggcctcgcattgtttgaacgttgccaaagacctgtggagcctctctgggttgaaggagcaggtcacaatgatgtggaactttatggacagtatcttgaaaggttgaaacagtttgtgtcacaggaactggtaaatttgtaaaatattctgtaaatttgctactgggttttcctttcttgctgaactgcactctttggtaaataacataaaacctgaaggttttgtttgcaaatcatgtcagttgccttcataaatgtacaggtaatgatttgttaacagacttaatgaaggttttaattaccagaactaaaaactggaaataacagtaccgtgcagtcaggctgtgtaatttatattttttctgtgaatttttttttaacatcaagatgagtactgtatgagattttaattctataaaatcaaatgctgtaaaagtattgccaaatgcttttgcatactagaaacaaatttataaatatttttaaaacatctcaatatattaaatcttatcctggaatacaactgtaatattttgaaaaaagctatgtatctaaagcaatttaagtactcataatggaatgaactgtaaaagagatttaaaaccatgcaagttcactagaattaacctaaaccctgttgtacagggatagaggtttaaagttattttattgtaaaatacattgaattttctgtatactctgattacatacatttatcctttaaaaaagatgtaaatcttaatttttatgccatctattaatttaccaatgagttaccttgtaaatgagaagtcatgatagcactgaattttaactagttttgacttctaagtttggtactgtgaggcaagtacttaaaattttcatgctggttacttaaaaggcatttagagatttcaagaatgattttgtatacgatgttttaaattttgactgatctcatagtcttcatagaattgcagtagtcttcattgtatgaaatcccgaaagtccatgagttgatcttaaagaccactaacagactggctatcagatcccttttcactttggctatttttttcattttttgagatggagtcttgctgtgtcactgaggctggagtgcagtggcgcgatcttgattcactgcaacctctgcctcccgggatcaagtgattctcctgcctcagcctcctgagtagctggtattacagatgcttgccaccacgcctggctaatttttgtatttttagtagagacagggttttgccatgttgatcaggctggtcttgaactcctgacctcatgatctgcccttggcctcccaaagtgtcggaattacaggcatgagccactgcgcctggcccactttagctatttttaaaaataggacctattgttttggattactatctgagaatttcatggattcactcctgggtataggagataagaatacgtttaattcataacttttatattaaccaatatagtaaaaaaataaagctcacacatacaaaaactaagttgcctttccttgaatgaaccctgtctgaataaaacaatgaaaaataaaaataaaattaatggtatgtagtctaatttgtaaatgaatgaatatggaaataatacacactgtggatatattttaaggccttatgtagttttaattgttctgctcgttccgtggttatgtttaagactatagtatatgactctcttcaaagtatatcaagtattgtgaatgctttggttcagatgtgtcaaattaacagtaaaacaacaaatataccactgacctgtgcttatttgcctttttccatgctccccacccccacactagaaagagtgaaaaaaaattacccttcgtttttataggacatagtttgaaaatttttaaaattatatcatcacttttttggagaggtctttctttctcaagattgtcttgtaaccta

SEQ ID NO: 16577 - DNA, 1185 bp, Homo sapiens
agccaaaaatctgtttggaatcatacctaaaatagtaatagtcattaaccaccaataaaatttacccatgtctgtgttttaactttttattgtatgagtctacattcagttattaaaatatttgctatctccttttctttttcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaaggtaaattgtggttggaatttatttttcatactcgtggtggttagctaaaaatatcttgtgtaagaatagaataaaagctgtttttattatacataactgctatatagaggttatatttactattatatacctgtgaataaatattttagacagcaattttaaatttcacataatagcaaaacaaagtttttaaagacagtttcaggtttgtttgtctacattaatacacgtatatatgtatgttttttttaacttaaattcttagctggaagtccatggtgcatgcctatagtcctagttacttaggagacaaagtcaggggaatcacttgaggccaggagtttgaggctgcagtgagctatgatcgtgccactgcactccagcctgagtgacagcgtcagacctcatctcttaaaaagttaaaaaaaaaaaaaaattaaatccagtgacaaatgtttggtttttgtaagctttcttattggagtgtgatataaaaaatgtttattcaaagctgcaacctttcaaggaaatgagagaaaatactgacatagctaattattcacttgatct

SEQ ID NO: 16578 - DNA, 1275 bp, Homo sapiens
ccaggaattgacgcttctgtcaatgacccggaagaaacaaacgcagcctttccgccccggctctgggtcagcccacgtgactcttctgggaggtcaaagagcatcgctctgccctccctgctgttaagccaagccactccacgcggcgcagcctcgacccctccggctccgcgcagcctctttctcaaacccggagaacaagtcccactttcttcgaaatgagaattcccccattggcccgaatgtgtagtccatcaaatcaaaggggcggggaacctttgttcctattggttcttcttttccgcaatccccgcctcctgctgagcgagctcagcctctccttgagctcagagcgcctcccaccctgccgggcggcctctgattggtggaagtgaggcaaggctgggctccgtctctccccccgcccgctagtaggctggagccggggtcagctttggcaccttcctccagtcagtggccaactcctggctcagtggggattgtgctcgtcccctccgttcccctccagtcttcctcccgctaccggaacgagcctcgcgcttggcaggctgaggaggagcaaagaaagcaggattaaagagaaggaagacctggctaggtctgggtggcgtctgcagtgccagaaagggaggcggtggcggcggcggctgcgaccacggccgcgcgggacgtgaggcccgagagcaaccgacgggcagcggcggccgctccagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcaggtgcgtgcggcctcggggtttggggacgccgcagcccggctcggggagggggcgctaggccgggagccgcagcgcgggagggacgagcccgggccggcggggggaggggagcgggaagcgtctttgttgttggcgaccgggatcccttctcggcacaggggaaaggcggggaagccactcctcatcgggtctgtgtttttgagaggattctctgatggttgcgtgaaggggagcggtaggacagtc

SEQ ID NO: 16579 - DNA, 1219 bp, Homo sapiens
aaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaacttcacttgttcattgggtttttaagccatagttggagtcctaaagggggaaaattagaaaatgttactttacatggctatataattttttttcctttgccatcgctgaacttgttcaagtgataatcaaga

SEQ ID NO: 16580 - DNA, 1598 bp, Homo sapiens
aaaccatagcactagtcaattataaattcaattattttttcctattacagtattattttatgtagttaagcagaagtgtttacacacacataaatcatcaaactgcattacttataagacatttatagtttttaaactaaataaataatttgcattcaagcaagtacctcattttgttcttttaaacaattattttattcattctattgcttaaattctgccatgttgtatttcagaattaattactaatgtatacctatacaatttattcttaacgaaagctttatgactgtgagttttcaatcacagtattatctaaattgctcccattgcttcatatgaaataaattcaatgatccaaaaatttacctgctttaatttttctcttcttatttaaaaatgataatattttgcaacatgttccataagtcattgaacactgtggcactgtgaattttcaaccaacttagagatgtcagatattcttattattattcatcactggtttactataaaatctatttttcttttttctcagaactgaagagagatctggccaaagacataacctcagacacatctggagattttcggaacgctttgctttctcttgctaaggtacaactcagatactttaggaaatgcctcttgttttataaagactaatttcttagtccattttgtgttgctataagggaatatctgaggctaggtaatttttaaagataaaaaggtttatttggctcaggattctgatggctaacaaattcaagtttgggtatctatgtctggtgagagcctcaggctgcttccactcctgacagaagaggaaagggagctggtgtgtgcagagaccacatggcaagaaaggaagcaagagagagaatggggaggtgccagcctcgttaacaaccagctctcgtggttctcatgagcaagaactcattcccagtgacggcattaatctcttcatgagagatcagccccaggacccaaatacctccctctaggccccacctttaacactggggatcaaatttcaacatgaggtttggaggggaagaacatctaaaaccatcgcaagtaaaatcttgtatctgagctccttctagaaatgagtaatagaatacctttttctcaaaaaatattatttatctgagtttaagataattaagtaaatcatgcaattacatgctagagaagagcttacaatagaatgggatttctttcagggtgaccgatctgaggactttggtgtgaatgaagacttggctgattcagatgccagggtaaggaagtgcttacaaaatactgctgcagttcatcttcctaccttaagtggggctaccacatgatcccctgtgaaagcaaatctaagatcttctgagagaccaatggcttcttaatgttcatttcctgaatgaggcatgtctttctgtagcccccacacacaaaaaagtagtctttgtaagttttcaatatctctcattattcgtaaaaccagagagaactgaagaaggacaatacaaatttgatttgtcattcccaagaattgtttgttaaaaaaaactctgacctttcgttgtactaggtataag

SEQ ID NO: 16581 - DNA, 1474 bp, Homo sapiens
attcctttaaatttaacaaatactttcacaaattgtaaatattaaaatgcacagatttcatcgagtacatgaagtacttagatgagacaaaatttaaaatgtatatttgttaaaaatacaaaatagaagattacaaaatcttatatgagtttgcctttaaaacaaatttgttttctgaaaaaaacttaattttttctaagctattgatgctctttgatctctcttttttctctaaagcacaatgaagaattttggcagtataataccttccagtactggaggaatcctttgcctcctattgatctggcagacattgaagatttaagtgaagacaccctgacagaagcaacacttcagggcaggaatgaaggggctgaggttgacatggagtcctgatgtaaggagccgaagcagtgggattggctgatttgaggagatgtctctaagtgaattctcgtattcttaagggaaaagttattttccatacttgaagttatatttccaaacctgagaaatgaagaaagattgttctgacattaaatacctacagttactactgaacctcttaataaggatttgtcaaggatagagtacagttgtaggggaagtattttatgtatgcattcttagagcaaaaagttttgtttaaattctagaattgaaggtactgatcttataaaaagaaattctagcagttttagaaataggtgggaaaaactcaaatattcctcctatctgcaccaaaaagtttatttgtggtatataaaatgaatattgttttataataacttgttaataaagtactttctaatacattctattgactctgttagttgaacaaatagctgacttgaacatctatgcaaacttaagatgggcgggattgttgtaaaagctattgttttaaaagagctttctaaatgtaaagtagtgataatttcaatttgggtagcgtgtttgcaaagcttccaatatttgatgttggttaagctctactatgggcaactgaagatggataaagaaaaatgaaaactgaatcggtgcctgcttccccctgttttcccaggattagaggaaaaaatttattgtataatcagcttcttggttttgaattgcttcgaggcatggttttattccttattactttagacctgtagttttcaacactgacagcactttaaaaatctttgcctgggcctcactcttgagagattctcatttaatagttctgaggtgggtcttggatataactatttttttaaacacctgtcctgtttccctccattcctctcatgtgcagacagggttgagaaccagtagactaatggtcgtttttcctgtttaaaggagataactaatttgagctgaagcaatgcttcttaattagctttgtttttgttttgctctgttggtggctttgttacaactgaattattgtgttattactatttcattgttaaagaaataaagtaag

SEQ ID NO: 16582 - DNA, 1279 bp, Homo sapiens
tgaatcttcctcctcagcctcccgagtagctgggaccacaggggcaggccaacaagcctggcctatttttgattttttgtagagacgaggtcttgctatgttgcccaggatagtctggaactctattataatctttgtcttaatctcatggagacgcccccgtggtcactgactggaggaaggaaatacacattttaaaggttttaaatttcctatagaagggtctagaacgtaccgcgctataacgaacatagtagtaagaccaccgccacactcctgaggaaacaaggtcacgcccctctgcgggccgcttgatcgggtctttaattaatcccgccgcggccttcccgcctacccccgagcgcgcacttccggtcgcgagggcgctcgggagcgcgccccgcgagcctccaccaaccagcggctccgcctggccagacagagtgcgcgcgcgcacgttgtgcgcaggttcgaatctccgccgcttcgcggttgcttctcaacgtccgggccgcatctcggcggcggcgagggctgagcgcgggagctgcctccgagccggagccccagccctaggccctgcgcgagctgccccgccctaccccctccagcgtcctgtcgcctcctcgcccgacttcggcctgtccctctctcacgcgctcagtcctcgctcttcgccccccgcagctatcggcactcggtctcccgcgcctggcgggctccgcccgagcctctgggcccatggccaagcggcgtgcggccgagccggtgacgttccacgtgccttggaagcggctcctgctttgcgacttcgctgagcagccgccgccaccgcctctctggatccggccgcccggggtcgcgcatgctgggcagctcctcggcgtcccagagcagcaccgaaagcgcaaaatcgacgcagggaccatggcagagccctcggcttcgcccagcaagcgccgtgacagcggggacaacagcgccccgagcggccaggagcgtgaggaccacggtctggagacaggcgatccgccgctgccgccgccgcccgtactgccggggccgggggaggagctcccgggcgcccggctcccggggggcggtggcgacgacggggcggggcgcgcaggacccccgcggggagactggggggtcgcatcgcgccaggtaggggctgggggcgggtgggctgaggggcgaaggggcttgccttttccccacacacacaaaacgccccggttcccactcatgacttgtgtaggttaagacgcctgagggg

SEQ ID NO: 16583 - DNA, 1214 bp, Homo sapiens
aagtgtttaattttgggccaggcctggtggctcacgtccaagcactttgggaggccaaggcaggtggatcatctgaggtcaggagtttcagaccagcctgtctaacatggcgaaaccccatctctactaaaaatacagaaattagccgggcatggtggcgggcacctgtaatcccagctcctcgggaggctgaggcaggagaatcacttgaacccatgaatcggaggttgcagtgagccaagattgcaccactgcactccagccttggtgacacagcgagaccctgtctctcaaaaaaaaaaaagtgtttaatgatttttaatgcattttccttcttggtactttcttttttctttgcttcagtgtgacaaacagtggcaaaacaacactggctaagaatttgcagaaacacctcccaaattgcagtgtcatatctcaggatgatttcttcaaggtatctataaaacttcttaaattatttatttaatacaaaaatgtttaaccaccacgttaattgaattacatccaagaagtctttggctagagatttacgttttgtattgaaattaggctcagtgcaatggtgttacttatccactagatggcactgtctatcagtgctgatctttctttgatcatccaaagcatttattaaagacttctctcctttttagtctataattgtattatttctttcctacacactgttttgatgggtactttattatttttccagccagagtctgagatagagacagataaaaatggatttttgcagtacgatggtaagtagatttacttgtcaaatattatatgcttatgttcattttctttttcaaacccaaagaacttcactatgttgaagttgatggttctgtggaacaaaaatttaaaaaaagaacttcactatatctgtgaaggcagtcttaaaatgtgtttaaatatattgttgtactttaagcctgcatttgtaggtttctgatttatgttgaactatttaaataagttaaaacctttttccagttttatatttaaaactgaaaacactggggccaggcttggaggcttacacctgtaatgccagcacttttggaaggccgaggcaggcagatcacttaagctcaggagtttcagaccagcctgagcaacatagggagattccatctctacccaaaaaaatacaaaaattagccaggtgtggtggtgcatgcctg

SEQ ID NO: 16584 - DNA, 2179 bp, Homo sapiens
ttaaattaatagttatagtttagcatataagagcagcagctttgagtaggttatttagcctttcttataggaactgaagatgcattttaaatatgaatatgaatagtatctgcttgttcttaggtttgattgttttttcctcaatttccagaatttcacaaagaaaaaaataatatatacacatacacacacatacacacacacacacacacacacacacacacacacacacacccctatatattttttaacagaatagaaataccttaagtatacccatttgggcaactattcccattaacttatcattagaaacattgatgttaatactttccattaataagctggaagtcaaaatgtaccataataaatgcattaatggggaggtcttaatttaatacttgctgattaatccattgcaaatggaaatttatgcagaatgacattgatttaaaagcaaaataaaaagtgaaagctttttttcttgtgttcttgtaaatgtaaaattctttcaggcaacttgagctggttgagagagtgtttggacaacagagtgggtgttaatggcttagacaaagctggaagcactgccttatactgggcttgccacgggggccacaaaggtattacattttgtttgttatatgtttctatgctgctgaaaatgtgtttcacctacgggagccagatttacaaaaaatgagaaaggaaaagcattggctattctttttgaatcctttagaataccggccaaaacccttgttcctggaagctctgtagaacagtgggtagaatgtggtcagtcagcctcactgcatgggtccctctcgcttgaaagactggacacttcctttcctctctcaggcttagaaaggttactggaaaacagcagtaatataaaaacaaaaccactgtctaatcttacagaaggaaagatcagaatttgctcctctagcttagcttttcacaaggtcttcttttatgatttgcattttaagtttaatgcaaactattagattcaagagaaagccaacatttgccaaagttagtgattccattgatactttttctgttgtaatcaataataatgacaaattgaatttttagatgtatttcttcctggacaaaaatttatcacccaccgcttttctacctctctctataacaaaagaaataaactcaacaacaataagaaatgaagatctcaacaaattaaatagcagtgccaaaggaaaatttgtaactgtctactaaaaagaagcctatcttatttcagctaataaacatgttagttatatgaatgaaaagtattatagtgaatgtaaaaatattcctctaagtgtcatatgaaaatgcaaaagccaaaactattagaaaaagtatattttcctaaataattccactttttagattcttaagtttttctattttataaattttacaaaatgtgttaacattttcttgaaggttcttctgaagaatctctcttttataaaattattgtacctagatttgtcaggcttctaattttcgttcttaaaaggtatcttttctctttgaatttcagatatagtggaaatgctatttactcaaccaaatattgaactgaaccagcaggtaagactgcttatttgaaaattatttaacacatacctgcttgttgtctttagtacagagcaactcatgggcatgtgaagtattgtagtcaaaatcccacaagcacataatttaaaaattataattgtactaaaattcaaattatccacagccccaagtgccaaacccactcctcctcatatgtcactttcagcttttagctctttcttcctgtacttacctttgtgttactaaggaataggctgacggagctatctcgccatgcattgtcttcatgtgtactttggcctcctgttgggtatgtgaagggttaagcttgtcagctgccccagctctcatctttcagcaccccagcaccaagcctgttctcctctgctcctcagtgtacttcatcacagtttttggttatattactatataatatttactttattatgggtgtctaaatagtgttcactgcttatataacctttttttgtttctgtacttactttttaaaactcattttttgttatctcactgtgacttctctactgttttatacagtcttgatatataatac

SEQ ID NO: 16585 - DNA, 1237 bp, Homo sapiens
agggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtgatattttttctttccctgtgtcagcttgaatcttactttatgtatttcgaatttgttggctgattgctactcttaagtgtgtgaagttgcctgaagagcaagatataggtggcagctgtagttctacaacaaagggccttgccttcaggatcccctgtgttttatgcctgcaacacagtgactgaggtttatttggagagcaatcacagggcatcactactaaagtccacttcctgagagtaagggttcctgttacattttggagatagaagagccagaagagtatagataggtctgggttcccttgcataactcctgccccaaaacagagttctgtaaccttcttgtcttttgccaccaaccccataagcagcaacttagaactcgtttgcctttctctgttgcatgctggtactctttgaacagtcatccccagaactctcatcttcctcaactatggaggcttacagcctgcagttagagcttaccatgaaacatgattctgattggg

SEQ ID NO: 16586 - DNA, 1170 bp, Homo sapiens
agcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacaca

SEQ ID NO: 16587 - DNA, 1258 bp, Homo sapiens
taaattgatcattttaattattgacttaaataatgttctgtgaaatgtagattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggtaggtactacggtaaaattaacatggcttaatttgtttgctgtttctatatttacagcttactatatagtctcattgttaagaagcactatctttttcaccctaattaaagtaattccagacttgctgtgtgattcttggtcactccccgccccccccttttttttttaaataagattaacttccttaatcaagagtgaaggatttaaatttattcagtacatgtttttgtgaaaacgattatttatgttgtgtgtgtattgtatgtctgtgtgggtataaaatctctcctaaattttaaataataatatatcaattgtatgtatacctcatatattcacatgtaaccactatgcacataaacatgtttttgttttatgtagtggtaatttcttttttctttcttctccaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttgggtaagaatctctattttttaaaataaataaattaatttcattgtttgactacctgctagagagttttcaattctttaggctctgaatcagtacatttgctgaaatattctcagagaaccattcctttttgagttaatctttaacttttatagttggtaatgtggggggcacaccggagataaaatgaagataattttattcattatggaaaatcagatgataatggttgaattttaaatctacttaactgagtattggaacacttaattagttttctattgttgctataacaatttaccacaaacttagtgcttaaaaacaacacaaatttattatcttagagttctgtatgacagaagtctgacacaagtctcactgggcaaaactcaaggtgtcagtaggacttccttttaggaggctctagaggagggtccatttcattgttcagtcaggtgttgacaaaattcatttacacatggtttaa

SEQ ID NO: 16588 - DNA, 2668 bp, Homo sapiens
aaagctggtatcttaaaatgtaagagagtaagactgtgaagcctaaaatgactggctgagaatgaaccagaaatgccatttgccaaacagttgtaactagaaatttgattctcacggtccattcttttctttgtccttaagatgacattgttagtgttcacgtcccatgttcagtgtccaaaccggcaatgtaaaaagtatcctgtgtggtttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggcttcgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcagaagtttgtgcctcatatctgaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgcc

SEQ ID NO: 16589 - DNA, 1161 bp, Homo sapiens
tcatatataacaggcagtatattataggcatcatctagttatgggaatgggaggggcaaacctgtctgccacaggagtcccctgctgcttttcctctggccttacttggagcccccatctgccatctcagccagtctcagactggtcttggcaactgacgacttgaaaactcagtctacttataaattggatactgcttacatgtgcatagaggataggaaagatactaattttcttatagaataaggttcttttttttttaatgagggagacataaattagtaataattacagaaaacacagaagtctgaaaatgtgctggacctactcctggctatagctaagttaagttggcaatcacttggcaagatataattagggcaaaaatgacctggaaatcttctaagatcacagaataacattgacgttttgaactcgatttttaaatggatggctttgtttgtcactaaatttttgttttgtttttccttctagtttcagaaaattacaggtgatgctagaattcctttgcctctcgactcctttcctgtcccagtttctactccagagggcttaggaacttccagcaacaacctaggagtcccagctactgagcagcggcaggagtcttttgaaggattcattgctagaatgtgttctccttcaccagatgcgacttctggaactggaagtcaaagaaaagaagaggagttgtccagaaatagcagatcttcttcagagaaaaagaccaaaacaggtgaatataccaaaaaacactctgataagcaacaccctggaaaggacctgcattcctgatctgactgtcctgaaaaccagaaaagcaaagaaactagggaaactagttctttggttaatgaaccaattaaaagtaggtctttgaaaaaatacgtttctgtcaagaaagaaaatagaatagtgactgtttcatccaagacaaataaaagtaaatccagtccactagaacattctgaaagtgatactcttggatgtgattttgaatttcaagaaagcatccattctctatcacacctttcatatgactaaatcttttgaaactatgtttttacctttaaattttaataaattttcttatgtttttattatggcatatggtgtcttaaaatataggattggaagcca

SEQ ID NO: 16590 - DNA, 1175 bp, Homo sapiens
tatgtgttctcttcattgggtggccaccattggttgcaggattagctcctacaagtttcttctttccctcaatagaaacagctttccttacctagaagtttgagtaaaggtctcagtaccaaattccattggccagcctggggcaggtactcatccccttgagccagggttgaccacagttgaaccatgtcgactgagagtggcagaggggtaatttcctaaaggaacatcaggctgttgtcactaagaagaggaggaagagcttcaggtcaaacagtaaccctaggctttcaacacagtctccagtaaatagttgtccaaggattgcataaataaatgagtgaattagggaagacaaagtagtattgtaacattaccatatttcttgtagtaaatccacccaagttaaagcacttggtagagcatcacttgttctcaatctttgaccacatgagtttatgtattgactgttacctatgcttctgcccagagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaagtaagttctgggagctgagctgggtggtgacgtgctcaatggtgggttaccccgacccagggcaatctgtagttttcaattattttctccccttgacagtgttagttcattaccatttagattgggtggctgtactagctaagactagagcctatgcatactcttactttattttattttctattttttttctagacagagttttgctttgtcacccaggctggagtgcagtggtgcaatctcagctcactgcaacctccgcctcccaggttcaggcgattctcctgcctcagcctcccaagtagctgggattacaggtgctggccaccacgcctggctaatttttgtatttttagtagagacagagtttaaccatgttggccaggctgcttttgaactcctgacctcaggtgatccgcctgcctcggcctcccagagtgctgggattacaggcgtgagccactgtgcctggcctatgc

SEQ ID NO: 16591 - DNA, 1221 bp, Homo sapiens
caatggatgtaggatagatggatactgggcgacaagtaaaaactcagatatctcccatgccttttgaaaaaatttactttattttattttgttgagacagagtctttctgtgttgcccgggttggagtacagtggctcttcacaggcaggatcatagcacactgtagcctccagctcctgggctcaagtgatcctcccaccttagcctcctaaatatctgggactatgggcacataccaccatgcccaccttcccatgccatttttgaagatgatttgttcccagtaaaagtcgaaaggttggatcgctcatcctctcaggatgttgataacgatggtaacaaaggatgaggctgggaggttgctttcactcgtgcaatgctttggagtcagttagtctttccctgctaggggaggcctgtcagtctcctggttgactcccatctatgtaaggaaagaggagagtgaaaagtgcaaagtctcaaacttgtcttctgtgatagaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaaggtagagtataaaaggcagggtgaggggaacccactgactcggtgtctgcagggacattttaatatatacaagagcgggaagaaccatgggtgtttgaggcctgcagaacccctgagccagtgcagctgccagtgagcaggctgccaggtgcgaattcccagctgttgcagtgcctgagtcctgctgttcccagcctcgtggtgatgtttgcctcacagggtcccactcgagtccttggggaactacctgcttttgagagtggttcttagaaacgtgtttggtcaacagacggggagagacttgtcttcaagagcagatgcagattatcccgagcccaggggacctatgtgagggagcttccccttgcctggtacccacctccaaaagcatcaacaggataccgttttatgagtggcttgccaaggcagggcagtgggactggcgctgtaggtacatgccccagggtgcgatgcgggtagagaatctaagaacaacagttgaactgactgagtggtattctgcctttttaattgggataaaatataa

SEQ ID NO: 16592 - DNA, 1196 bp, Homo sapiens
aaaaattcactgggcatggtggcacacgctgtaatcccagctactcggcaggctgaggcaggaaaattgcttgaacccgggaggcagaggttgcagtgagccgagattgcgccactgcactccagcctgggtgccagagcaagactccgtctcaaaagaaaaaaaaaatgtttcttctcttggtaaccagggagagttagaggccccacgttaaagactcctttctactttgggggtagaaaggaggtgtgcagagcgaatgtgaatatgtgccaggactttgcagtgatgggcttgggttagccccatccaggtgaggaccaggctgacggatcatcctcaggctttggaactctgagtatgggtttgctgtccacatggagattgctttagagcatgaactgctccctacacaggatagagtcatttccttaaaaaaattgtgcttcgggaagagttgggaagtttgcatacatgtatgaaaaatggccaaatccttcttaagcagcatgtctttctctttttaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcaggtaactctgggagtcagtcttgtggacccagggaggggtctcactatttttcatcaaagcggaggttacattttaaaataaaacatgtaagcctgggcgcggtggctcacacctgtaatcttagcaatttgggaggctgaggtggatggaccacttgaggtcaggagctagagactagcctgaccaacatggtgaaaccctgtctttaccaaaaatacaaaattatccaggcgtggtggcacatgcctataatcccagctactaaggaggctgaggcaggagaatctcttgaaccggggaggtggagattgcagtgagccgagatggcaccattgcactccagcctgggtgacagagggagactccatctcaaaataaataaataaataagcaaacaaacaaacaaataataagtaaaataaagtaaagcatgtttccaggagccggtgatcaaatgccccagatatcctatcagattctctgcccagctcacctctc

SEQ ID NO: 16593 - DNA, 1466 bp, Homo sapiens
acatcttgcttgctttctttgccaagagtgaatagttcgaatgactctaaatgtgagcatggtgaaccttcacagcttaagggagaattttctgatgactgagacgtgtgaagctctgtgccaggtgtcgggagtttttaggtaggagaccggaaatgatggtctcaggtgctgcaactctcaggagccagtggctagaaaaaggtgttttgatgcgaaattagacgtttttgttctcaatgcctggatctttggtcattctaggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaagcccttgtcaatgaatttctctacctgctttttagacaaattgttctttatgatgggaaagcttgaggtctaaaaatagcacctgctaa

SEQ ID NO: 16594 - DNA, 1152 bp, Homo sapiens
acagaacggcgattaatgttcagccacctctgattggttggtggagacgcctaccgcaacgggggtgggcggggcgcttggagagctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagtgagtgcgg

SEQ ID NO: 16595 - DNA, 1169 bp, Homo sapiens
taactgaggagtctcacaaggcagtgagtcagccttgctatggactttgacagaagtatatctgaagggaagggagtgattgcagtattcagggtgctggggaacagcagacctggttcagcaaggggaggttaaggactatactcccacccctactcaagacatgaatgcctctcatagtgtgatccctggttgctttgttttcagtgaagattagcctcagtttctccgttaaaaaaaaaaaaaagtcagtctggaagattttatacggcctatgctttttaggccattgaaacaaaacactttttttttttttttttttttttttttttgcagaggtggtggtgggggaggggggatgccctttcagtgattagtgccctgctacatagttgtcttccagagctacaatgtcaaggagccctcctgtcctggggagagagggtgcgcagaatggaaattcagcttgctcaaagagtcataccaacagggctctagcagatttcatattttcttaataagaatgacaaaggggccagagtcctggaaagtaagatacacactgggcataagatggtgtttgccctcatgggaagagtgtggttttcccacaggagaatccagaataaccaaccaacatggccaagtttcccactgtgggcgggcagtgaggggcccctgagcagacaggatttcaacttcccacatgagccagggtgggtctggcaaaggtttaggagatgtctttcaagtgaatctgtttttctacatgttttctacctctggatgtatagagtcagcttcctgcatgacctgtttttgtgagacagaggacctgggaaacatgaggccatatttgaggcggttcattcttaccaaccgccagacctttgtttttagagaagtggaatcttcaccaaaggcccaagaagcctttgtggggtcagctgtgcttgagaattcttgaatctttgttactctttatcacctacctgagatgccacttttgcttgcttagctcaggtttggaatttgatttaagagggattcacatttctctgtttatcagaacttagcatcaattgtgtttctttgtagagatgtatgttacttaaaagataagggaaaggagcatgtgtttctgtagctcagaaaaccctaagaggaag

SEQ ID NO: 16596 - DNA, 1218 bp, Homo sapiens
tgtggagatggggtctcattatgttacctaggctgggctcaaactcctgggctaggattacaggtgtgagccactgcacctggcccaaaacatattcttgatttctaaagggacccactttttatttacataaaaattatgtactactgattttatatgttattgatctttttttttttcattgttcttattctattaagaataaggtgtcattctctactgcagtgaaggcacaccagatctctgtggtcagcctgcaggtctcattgacgtgcaatttgcagatgggtggggttttgatttttctttgggttttaaataagtactataaatactataattttggggccctcaatactgaatattttcgttagtagtttcagtgagtattgttatctgttctagcacatttgtgcttctaagcatgcattaaatgcttttggctagaaatgtccacacccaacaaccccagcattataaatgtgctgtgcttgcattactgtccacgatgttcctttgtaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttgtaagcagctccttaccatctctctgagtgtggcctctgccaatttgatgtttgaatttgatgtttttatctttatatttctcacatttttaacaggacttttatttccaaatgtatatatgttcggtatttaagtttaattggcaaaagtatgtagagcagaataagtttactaacttgttggtgatgagtgtttattttatgattctttttgcaaggatagaagagggatatggggaaattgagtgaaacacgtcttagcgaagatgaacaatgcacattggggttacagagatggttttgtcgcctgtggtttatggtaaatttagtttggggcttgaatgtgattttgttgctagctttgtttgaattaccaagctacatatgacggcaataattttcccttcctatctaaaaagtaatctctcatttacaaaagtctatcttgacttacatcacaaatcacaaatgcaaaaatgaactgctcacccatcaggataatctccctgcaccctattcttctgtggctgtgtagttaattgc

SEQ ID NO: 16597 - DNA, 2339 bp, Homo sapiens
gagaccctgtcttattaaaaaaaaaaaaaaaaaaaaaaaaaaaaaaaagcagcagtactgtccatgaccacctttcacctttccttgactgggctttctgtttggtcaaggagcacattacatttgcatttgctctaagtcctccatactcatgggattttctttcagtatttaacatttttgattatatgtttctttcctagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagtatgcttatttttctaattctttgtcttgatgacattagtttattttttatctttggctgtgccactcctatatattaaaaatgcctagttttttcaagggagattgttgttaaagtaaagtggttttttttgttgttaaagtaatgtgggtttttttcactgttgctgtttttgttttggttttgtctttacttgagaggagctagaaaaggtaggtgatagaagttaacagtgaccagttggtgctaaatatttattgagtacctctttgatttataaaaatactgcttaccaaaaggttatcatgtccctcaaacccttgatgctttagagctatgctgttcaatatggttaccctaggcatttgtggctctttaaatttattaaagttaaataaaactagaaatctaatttaccagtcacacaaact

SEQ ID NO: 16598 - DNA, 1199 bp, Homo sapiens
gtgagcaaaatggaatgatggagccagggccgaacgccctctccaccttttatcctagcaaaagttacttgtttttttctttttttaaaactccataagtagcactttcaaaatatcaattctaagcacttttcaaatattcctccacttagttctcataacgtctgtcctgctatttgccccattttatagaggaagtgcctgaggctcagagagggtaagttactggcttcaggtcacacagtcagatgtggtggagccaagttgaggcccaggcattctgctctcgtctgtactctgaacccttgctccgtgccggctcctggggagtaaatacctgttggatagaatggggtagcgtcttacaaatctttctctggaccactcacaggtggctagtggctgctgcatgtaatagggccatgtaaagcctattgaatgtctttgtatccactgtaacccagcacgttctgaacagtcataggatgtgcctgagagtaatgctggagtatagtatatggacggagagagggcagagggatgggggagcagctgccaggtactgtatgtcagcagaggaaggtgttttcagtcaaggaggaacagcgtttcatgagttagaaaggtcaaaagaagtcagagggtcactggatttccagagctgtttgaagggaaggaaagcaacactttcaccaagtgaagcagggactgctccaggcctgggtgttctgtggggatgtctgggaagcaagcggaaacattggaggtccagctgcacggccgcaggagagaggactcaacctggatcctaaagtgcagaagttggggatggcttgcagagagaagattttaaaagtgatggttcacgtcttggcttagaatttagggcagtagtggtgctttttccttcccttgcactctttaaaatccaagctcaggttaaaagtttggagctctacaggaatgataaggtgtggggatcctggaggaagaagcagcatggtaactttcttctcagtgttgaaattcccacgcagttctttactggatcccgcctgcttctgagggtgggtctagactttgctcgccttttctggctgcctcccccaccaccttcctctcagcatgcagaactgagtccaccagtcaccgtccctgctggggcttacactgacctcccctcagcagctctgctagtt

SEQ ID NO: 16599 - DNA, 1170 bp, Homo sapiens
cctccatcgccatcactgtcaccactacctcctcctcctcctcctttttctctctcaccaccaccaccaacagcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagaggtgagaggccgggcaagccagattaggactttgtcctcatactcttacagtgctgcaaagttgtgtgcatcgctaaagagagccccaacctatacagagagcaaacaatgagataagaggaactgtcgcaaagctttccactgaaacacaggtcaccctggaagtttgcagggtttgctgtgggcatctgtagatttctcgatctcgttagattgcaggcatcttgacatcttggcaactgcctagttaatgccagtggcctgtaccatattatggaaaactgttaactgcttaattgggtaattttcaaagaaagtaatgttgttaaatggggcgaaataagaagttaaatttgaaagtgaatgtgttcaaatgaaaggtttgataattgcatctgttactacttagtttcataggctttaattctagtatgcattaaatattgggcaaaattgcacttgactaattttttgaagaaaagtaatttattctgtcaagaaataaaaaaataggctttgtgtatggttaaactgtaaatcttatgtttacaaaatactgtaattttcaggaaatcactgtattaggaatgtgcaatgacttatataaataaaagccatttttaaaactgtttggggcttgtgttctaattattccccccttttttttatttctgttcttgcctctgtgtctgaacgggcatgtctgtgcgtttcttggtaacctcgggagcagacagagagccgggcacagtaagtactcaaacgcctgctgcacacacacacacacacacacacacacacacacacacggtccccttctgacaacacttctccacacaggcacagacagacatgcacactctccctgtctctctcagtgacctggctttttt

SEQ ID NO: 16600 - DNA, 2447 bp, Homo sapiens
ttatttaggtacaaactagactatttaaaataaactgctaatggacttttaaatatgttggataagtttcaagaggtgggcagtgtttttaaagctcagtagatcagcatatgttataaaaaagcaattaaaaaattttaaaagtcatgtgtggcagggactggcttcctttagagttggattaattttttttttctttaatagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagcttttacacttgatttgtcttgcctcttttgtagaaagaaaaaaagtctttaacttttgctaaccatgtgttttaaaggctattggagttgatttaccccagattttgtcacattttacattctttatttttcaggttttccaattaaaacgtcacagtcttttgtggtgtgataaaaagatagcacactgggaaggtaggtgacttgagctccacttttgatcttggtacttgactagttatgtgacattgaggcgtcatggtttctttattatacat

SEQ ID NO: 16601 - DNA, 1183 bp, Homo sapiens
taccattttactcagtgagtggcagtacacagtgaaaatgggtggaggcattacatcttttgttgccttgggcatgaaggcttacttctttcataagggtgggcaatattaagtgccgaatatgattctaattaattctttgcagtcttggaggaaaagttggctcagtccttttcactttatggaatttttcagcagtaattttgaccatacgtaatttttgccttaagttgacttcagaagctagctcttcattagacaagattttactgtaaatgcagaatgtttaaactcatcagtcctcttttcctggtatatgttgggcatgtacttttagagatgttttagttttaaagttctttcgtagttcagttgatacataatatgtataatcatttgtacttggtgaaattaaacacagtgcatattatattttaaagctttaacttttgtttaagtatttttccttaatatgtcttttttaaaaacaaactttcagctagtatgttcaacacaccaggaatgcagagcttgttgcaacaaataactgaaaacccacaactgatgcaaaacatgttgtctgccccctacatgagaagcatgatgcagtcactaagccagaatcctgaccttgctgcacaggtgagtttgtaattgtattgaaaaagactgtgcagtgtgaattaaaataacctaatcttgtaattgtgattttggcacatttgtgttgtgtatgatatcttaatacactagaaaaataagtaaactgtgtctccaattttttagaccgtgtgtttctttgcagtaaattaatacttcatatgtaattaaaacaactttatctctgccattcattgactagaaagaagtgcaggtttagtttgtttctacatatgttgagttaggagacaagtacagagttctggaatgcccactcttttgaagataaactacttaatgaaatgtaaatcttgaaagcaattaagagcaatgttaatacatttgaaatacttttatttagtagatcactcagattataatagtcatgctcagaatggcagttgtaaaatagcatttattaaagacgggaatttgtcagaacaatgttctccttctttcaactattgattcccctgctgaaaatcgtatacaggtcccttattaatgtattcctttttctaat

SEQ ID NO: 16602 - DNA, 1912 bp, Homo sapiens
gcccctttcatagttcactttgattacatggcacttggcacaagtggctctattttggtttgttgtggtctgctggggcatagtgcaggaggctggtccaaaacagtggcctcctggccgggcgcggtggctcacgcttgtaatcccagcactttgggaagctgaggtgggcggatcacgaggtcaggagatcaagaccatcctggctaacacggtgaaaccccgtctctactaaaaaatacaaaaaaaaattagcggggcgtggtggcgggcgcctgtagtcccagctactcgggaggctgaggcaggagaatgggtgtgaacccgggaggcggagcttgcagtgaaccaagatcatgccactgcactccagcctgggcgacaaagcaagactccgtctcaaaaaaattaaaaaaacaaaacaaaacagtggcctcccataaactttgtttaatggcagttaataaagtaattaatgtaattcatgtgtatttcaatgccttttttttttctttttttggaaatatttttcgtagacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcaggtgatccactggctccaaggttcaggccaaggagtagcttctgttttaacacaaatatgtgtatgattgagggtagcttttatatgaggaatgtggttttcaatttttaaaaagttcagtggccgggtgcagtggctcacgcctgtaatcccagcactttgggaggccgaggcgggtggatcccgaggtcaggagatcaagaccatcctggctaatacggtgaaatcccgtctctactaaaaatacaaaaaattagctgggcgtggtggtgggcgcctgtagtcccagctactcgggaggctgaggcaggagaatggtgtgaacacaggaggcggagcttgcagtgagccgagatcgcgccactgcactccagcctgggtcacagagcgagactccgtctcaaaaaaaaaaaaaaaagtttcatatcttatttaaaacaaaagcttattctttgtgattttttatgtcttttattacagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggaggtatgcttttaacaactcaggcttttttctttgttgtcctcatttacataattaaaacattgtttatactcttattctttgtgcttttgtgtgtatgtatagtgagtatcttttataaactatatttttcatgttgcttttgttttgttttgttttgtttttttgagatagagcttcgctcttgttgcacaggctggagtacaatggcacgatctcagctcaccgcaacctcttcctcctgggttcaagtgattcttctgcctcagcctcccgagtagctgggattacaggcacctgccaccatgcccggctaattttgtatttttagtagagacagggtttctccatcttggtcaggctggtcttgaactcctgacctcaggtgatccgcctgccttggcctcccaaattgctgggattataggtgtgagccgctgcacctggtcacattttgttttttaaaggaagctttaaatgtagagagaacacttatttacttgtgt

SEQ ID NO: 16603 - DNA, 1155 bp, Homo sapiens
cttttcattttgagttttcttaattttattgttgaagaatttgcatagagctctatctccacctccctacccttactttcttggtgggtggggctgaaagttttagccctttaatcactttgtctttctggtgaccagctcctttctgaggctttccaggggcctaagtcacttcattagcataatgatcaaaagggcttgtaatgaataataaaagatactcctgtcactcagaaaattccaaagttttagtaactcaggatcaaggagaaagaccaaatatatttattattatactacatacatgaaaatatattttgttgattttattactttaattaccaaagtgtaaatttttggctaatttcaatgataggaattaaatattagtaataggtattcgatttgtttttaaatgatttcttgtaatagactattgggtcagctaatacttttttgcatcttcatattttatgtcatgttaatgataaattttctgactttgatttgtatgtttttgccctttatcctcttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaagtatgtggaaagttctttcagttcgtttagctaaaaaatgatatatttgttatttaattttctgtggttaatgagattgtcctgtatgtatggttaagctaaagagagaaatccttatcttggtttaagaaaactcaacaaagcgctaatttggctgtttgaactctgaattttctgttaaattgaaggatctttgtaaatagtttattttgaaggcttaagaatcaaaaagtccaatgctggagatgggaaattcactcataacaaagtgcttccttctttatgttatttgaatgctaagttgcttttttgaggtgaaatacaccagggattatttaaaataacctcctgcctta

SEQ ID NO: 16604 - DNA, 1839 bp, Homo sapiens
ttagcattgaaattgtcttgatgttgattaagatgttacgagcaaaaattctaattcgcacttttttttcttttcttttatagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgtatttttttgtgtgaagtgtttttctagcatttataagtgaaagctggcaggggtggtagttgggctcataattaacgtggtaatttagcaaaatgagagcctagtcatccaattttttttttcttatagtcagccagagctttcctcattacctatgagaaattttgagtgagttacttggttcctttctctaaaatagctttagtttgatgtttgagaatatcggagataatgtaaaataactgcagagtatggttcccggctcatatttctgaagtactacttattaacctccagctgtccagaaagcttgaaaactgtttttgttttgttttgttttgttttttgagacagtgtcttgctgtttttcccaggctggagtgcagtggcataatcttg

SEQ ID NO: 16605 - DNA, 1238 bp, Homo sapiens
aatggtgtaatccaaatagtctacaactcttgatctattttgaaagtaatttagtaattatttgtttattgtttctgtcattctctctacactttgttctttgaggtcagagattttattcttgtttcggaatccccataacctggtgttcagtgaggttcactaaatttattagagaaatatagagtaactgaagaattttttttataatagtggtttttttttttttttgcatataactcgtttcagaatttccctgcactttccataacaaagcaaaaacaaaaaacactatttcttcatgtggttagcttagatggactttaaggtgacttgagttgacatttactaaacaatttgtatatgtttttgcctatgtatcactaagtatacacatttttggttgtcaaaccttaaaataattttgcatctctttctccccctctcagctgtgaattcagtatccttagggaaaaatggagttgtggaactgatgtttaaaatcattggaccatttagtaagaagaattccagtcttataaagtgagtaaatgttttgaatgtaaacataggtatagcctttgttactctgggcctcattatcttgatatgtacaatgagcaggttgaattaaattgtctccagggttatttcatttcttagttcttaaataatgattttatcatgataaagattttctttagtataaaatttaatcttcacaaatatctcaaaattggacagttttgacttcattgaatataatgtttatagtaacttagactgaacatttctagatactgtaaaaggaaaaaagattatctatagagtattcattcagaaacatttattgagtgcctactatatttctcacccaattttacaatcttgtaatgactttttcattcttatgaatacctgaacaatcttaaattgatacatttctattttgtcaaaatcacatcattctttttcccccatcctgagatgtgtgtgtgtgtgtgtgtgtgtgtatgtatacacacacacacacacacacacacacacacacacacacacatgtatgtatgtatgtatttttattcattcctaggcctttcagcctcagaaaatgaaagccatgtctcatttattggttacagtttaatattttcttaagccattttagaggtctttctttaaaatttttttttattgtggaatttttaaaacatacataaaatagagtttatattaaa

SEQ ID NO: 16606 - DNA, 1138 bp, Homo sapiens
tacaaatatttgtatgataaataggaacagggaagaaagaacataggtggaggataggtaggcttaaggatctggtgacaggaaagtgagtgtattcttgctggatttataccagttatgaagcagggcactaactgagaatggagtcggatgggaagaaggattatcagagttttgaggagagcagagtaagtgtaaaaagtctttgagagtggaaaggtgaactttccaggtgtgatgtaagattactgaacagggttgaagggatatttgtgatttgtggttttctgaaatagaatgtgtttctcacttaagtcagtagaatttaagctatagaacaatattaagctatattaagctatagaacagagtaaggaagtgcgacgtgtaaatgctttctgtttttaaaagagtagaattgttttttaaacagtgatcgttatagtattgaatttacaccattgatttagaatgtgccctaacattctacgttctttttagccttaccaataattctaggatcgtaggactcctggctcaactggagaagatcaatgctgagccttcagaatcagacactgcccgatatgttacatcaaaaattcttcatctggctcagagtcaaggtaaacattgatctcttctttgtttttgaaatgcttttttaattctttaaaagtggatgctaaaaatgttcaaacttctaataatggatgattttccacaaaaattgaactttcaggccgggtgtggtggctcacacctgtaatcccagcactttgggaggccaaggtgggcagatcatgaagtcagtagttttgagaccagcctggccaatatggtgaaaccccgtctctactaaaaaatacaaaaattagccgggtgtggtagcatgcacctataatcccagttactcgggaggctgaggcaggagaatcactggaacccaagaggtggaggttgcagtgagctgagatcgtgccactgcactccagcctgggcgacagcaagactccgtctcataaaaaaaaaaaaaaaaaaatcaaactttctcaaattgactcgagtggaaaactgaataactttggaggaaattgatcttcaaagcatggtttctaataatgattacaattttact

SEQ ID NO: 16607 - DNA, 1095 bp, Homo sapiens
tcatttagaccatggtagcatttgacatggacggcaaagtacgtaaaccgaagtttgagcttgatagtgaacaagttcggtatgaacacaggtttgctccattcaacagtgtgatgaccccgccgccagtgcactacttacagttcaaggtgaacctgctcaatgaacttgttatgaaatctttagtcttagaccttcttagagagatgctgtttgtacctagccatcttgttacattaacagttatttaaatcataagaataatatgaggtagcatatgagggttgagaattatatattacctaggaaaaaatagggagatgtgctgaatgtttgccccagtgtctgtgtatgagtggatagaaaatgtagaattctttaataattagaaatgggattttagagttgttcatattaaacgtgttttgaattatacttccccttctttttaggaaatgtctgacctcaataaatatagccctcctcctcagtctcctgaactgtatgtggcagctagtaagcactttcaacaggcaaaaatgatattggaaaatattcctaacccggaccatgaggtgagactggattcacagtaattctaggggaaaagcgtggcaggaaatacatctcttactgctggatgaaagttaattatgaaagtgaactttaatagtgttagtgaatagaacttggcgtgtttctgcgaaggatttcaggtagttttgtcaaactaacgttgtcagacttcaagttattttaagaatgaggtgatataaatatctgctttgtataaatttagaagtcaatgcaaagacaaattacaactcaaaatcataaagaaggataagcataagatccagactgatctgattcatagctcaaaatgtaagcattgaaacatttctgttttaatcagtagtttgttaaaggggccaggcgtggtggctcacacctgtaatctcagcactttgggaggccgaggtgggtggatcaccttaggtcaggagtttgagaccagcctggccaacatggtgaaatcccatttgtactaacaatacaaaaaattagccaggcgtggtgcatgcctgtctgtaa

SEQ ID NO: 16608 - DNA, 1212 bp, Homo sapiens
attgtacaggctacttaaaaaataattttttttaagatttttcggttctgaaatttcaggacacctaatggctgttcttgaataacacaagtattaccgctcttggaaaggagagccaagagggctcattagctgcaaagaggggcaacaggaacacccttagcaagttcagtcaggttagctgctttaaagtactgccagaaaagtttcactatactatcatgtttttatgaaaggtaccaaatcagagttaagatatttgaagctgagaacccttttaaccacagaccaaatataaaactgtcactagtcttaggctaagccaccaaagccaatttacaccacagagtaactcattttgctaagagtattgcctgctacagaggacaaaaaggaaggcccaagaggcctagaaagctgccaccgcaaacatcagagcagacacaggacaagcaggaaaggaaggggagggcctctggcagcaggcacttgcaagcacagggggatgtagtcagtttttcaaagccagaggatactgaacagacacccatttgaaaatgtttcatgggttaaactgaatatgaagtaaacaaaaagtacaccacatttaaacctagtcctaaattttaatctatatacatttctatctgcctcctttttgcatgtcaccagcaaacaatgtataatcttttaaaagtgctaaaaggattttttttacacatctgtattcttacagatatataatttgtgatgtcatgacacataaaaatcacaattttcatgtaatttagaggccctcccaaaaatcccttctaaatgtattttaccaaaatctcatacaagtgtttaattaatcccttgatttgaaacttcttttggataacgtttttggaactactcaaatgttaaagagcatacaccttcttcagttcttaacatggacaaagacctactgtttttcatctccagcagtgcattttttttttgtcaagaaatttattaacctttataaacactattttcactcaatcattcataaaaaatgatttgtgattaaatctgtaataaaaccatataacgttcatcaatgcattcaataagaccagtttcttccatggaacataataaaccactttaaaacagcagttttcattcatgtcatataaggctgtcaaactaaaagtattccttataatgagttgttacccaaga

SEQ ID NO: 16609 - DNA, 1152 bp, Homo sapiens
tggtggtgcattgttttttccacccaaacttaacatagcctttttatacatttttatgaaaaatttcattgtcagctgcctcactgcatactctttaatagtaccaggcaaagattttcttcaactatagtacagattagttctgagtgatggtatcaaaaggtgagaaagacgtcatccgcctttttttaatccatttcttttgccaccctatatgtctgttcagagatgggctctcaagctgactttgattcttttagttgagaagtctcttaaagccatctagcccacctccatcaattccctatgtgaggaagcaaaaccccagggaagccaaagggctcctgtccaccctgacaccacaggccgggggagagtagggactctacccccctctccccttgtaggtgacacatgctctgccctctgaggcagtcagcgaaggcaaatggtctgacttctttatgtggtcaacattttgatagaatttctttataatttgatagagattatattatttttattttattttgagtgggaagaattttaaaacctttttatgtcaattaccatcttgtttctttcacctttgaaacaatggtttgtagcagagatgacattgtagcaacccagaattatgcttttggaatgtggtcctcactgtacaggagaatgtgtaatcttttgttaaaattcccagtgtgcatacattttctggttcctcggtccagttgctaaagttcttagtattttagcctaacatatttatcaccaacttttctttaaaagtgttccttttgtcacttagttactgattttcctgggtttgacataagtattctatgagatgatatatatgctttttttgaaagctgattctcatgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaacactgtatgtatgtagagattgagttgtcaattaaaaaaaatgtggcctctttgtgatcataaaattgccttttattattgaggggagagggtttgggacagcagctgctaaagccaata

SEQ ID NO: 16610 - DNA, 1389 bp, Homo sapiens
gtattaaaatgagatcactctaggaacctgtctgcattcagaaagaattttgactaagcttatatttaattaatcatgtgcatatatacttttcaatatcaagtcttattacttgattcaaaacaagtgaccaattctagtatgaagtttttgtgactacttaataagaagtaattttatggcttttgtcataaagcgaggcttgtttcatttatattgggttttgtttcttcccctcctctaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcagaatttcaacctgtaattttatctacattattttctagtgaaagattcctaaatttcctggggaaaaaaaaaaaagatcaaggagtgagaacattgggaatgatagtaagaggcgtttaacaaaaaagaagaaaggacaaatatactcc

SEQ ID NO: 16611 - DNA, 1183 bp, Homo sapiens
gtttattgggattttgttacagcaaacgctttttgttcataatataatgagaaattcatattaaatatgtcaaaagattatttttattattgttttactaaaacctccttatagtaaattacaccaatgggtgcattctaaaaggtgaaaagaaacgtttgcattagctcttgaatatactatcaggtttataaatttaaacaaagacattctttttcaactggcacatttaaaaaaatattttaaatagtattttcttcataaaatgtgatatttagataatagtattttattcataaaatacatgataacgtagcaatttgacgttttacaactgacatgaagcgtggctgttaagctaaatcatagttgatgcagccttccctattaaattaagtgaagagcaaagagccacctatttctgtcctttgtttatgctagtcttgaatacaagtttgcttttgtgtgtaattttaattgatggttctgcttctgaaatagcagtgttttgttataacttttgagaaattctactgtatttattacttttatttatttatttattttttagattgttccctaagattatatgggtcatcctgtagcagattgggtttcaaaaattcggatgtaaacattgacatccagtttccagccattgtaagtacaaaatgaaatgctggcactttcagagtggtatggaaattctttcttacaaatgtaaactgtctatgaatatattttagatatttgaagatattttaagtgtaatgacagcatccgcttgccttcagtttcagagcttttttttttaatactctgcaaattttcatacttattttagtctatagatcttttatacatccaacactggtttttcaaccatgtgcacctgatgggggtgtttaggttctgttacttaaaaagagtaaattttcttgataaaatcaactttccagtggcagaaagggaattcagattttaaagtgtagatatttaaacatttatgatctgcaagcttaattgtctctggagtttcctctttttgtatacctattttgttaaaataattaggcttttaaagaatcacacctagcctggatttctggtttaaacatgatttaaaagtatgttgatgagttagaattttaaaactggagtgtagctggacacggcacagttc

SEQ ID NO: 16612 - DNA, 1155 bp, Homo sapiens
gcctacaaccagtacgccgaggcgtgcgcgccggtgctggcgcagcacggcgggggcgacgcgcccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggcggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggag

SEQ ID NO: 16613 - DNA, 1150 bp, Homo sapiens
tgcagccttgcatctatatgtcctttttaatagaaaattaggatcatatggatgtatgtagttgcatagcttgcatttttaaccgaatattacattatgataatgcatgatatatttttaatttcatcttcaaagctggcatcagattgtactatgtagatttatcataattagctccactgttttcctctggtgaatgtcattcttttcttccatgatgggtacaaatagccttgtaaagcaatctttgattgcttttctgattatttccttaggatagattgctagaagtagatgcactgagccaaaagttataaacattttaaaggttctcgttacatggagctaaatttgtttccagaagggttgtgttgtctttactcccactctgaataagacagtgcctgtttccttgtacttttgctaaagttggctattatcttaaaatacaaaacccaaacaaaaccagaaaacaatcccatttgccactttgcagagccaagtgttcgtgcccttgacctctagcagctctctgtgaatgtggtcacagattcctacacccatgtgtcttcatcttccttttactcatctttcagagtcatgtttatctttcaatgtctgacagctttagtttggggattttcgtcttatcttgggatttgaggccatctgggcttctcagctctgctcttgctgctccatctttattgtatctgggcttcatctctaatgttttgtaccatttagcctctttgtgccatgcacaccagcctagaccagtgtggcatttaggatgacaccctcataaaggcccttaataaatgctctgggatattgcagcaaaaggcacacatagcattgcaaagttaaattattcaggctcaccgaagtatatataatctattccaaggtgagacagcaccccctccccactgatgcacacatttccccacctgcttcacacacactcactcaagtgcacttcttcagtgcatcacaaagggaagtctttgagggcctctcactaaaataatcagagaatccatcttcttggacctccttgataaatgatgtttgattgaagcggtgaatgacttgttgcatactttcctttcaaactgagtgtgcattacccagatagagaagagga

SEQ ID NO: 16614 - DNA, 1182 bp, Homo sapiens
gttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatat

SEQ ID NO: 16615 - DNA, 3138 bp, Homo sapiens
ttaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaactcctgactgtaaagtttgtgctgatgagcaacatgtgatgtgttaaacttgattctgaaaagttttttgggccaagtaaccttttcaccacatgtaaatgtcagatatgcatagaaagaaatagaatttttatttgataacattcaataatacctgaaagaagaggaggcagtcatcaatatcacacatatattaaatattgaagtttgcaatttgacatt

SEQ ID NO: 16616 - DNA, 1199 bp, Homo sapiens
ctcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgta

SEQ ID NO: 16617 - DNA, 1150 bp, Homo sapiens
gccagggcacctctgagcaccgtgagctgctgggcagtggccacaggctccctctctcatgctgctggttttcttacaggagttttcctacttgttgatgcctattcctcactcgtgctgttttctcattttagttgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattattaaattttgtttcagactctggtgattttaggcttctcagtggtctctgtcttacttgatgattcctatgtcttaatttacctcctttggacagtctg

SEQ ID NO: 16618 - DNA, 1412 bp, Homo sapiens
ggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaact

SEQ ID NO: 16619 - DNA, 1188 bp, Homo sapiens
caggtgctcacattctggctcgggggacgaggttgggcttcgaggtggtgtgcttcagcctctggctgcagccccttctcacctatagtgaggccgggaagatgaccgggagtgccaggctcatgcatcctctgctgcagggaggagatctggaggtggggactgaacagcctccccactggctaagagaaacacgtgcagagaagcgctttgctggagggcaggcacctgtgggtgcccagacaggggagagagggatttggacctaaggcccagtgagccctgacatagcacgtggattctgcaggaaggtcacagacctgccttgtttgcctctggttctgagtacctctcctccttactgcaatgtcccctgaaggtacactctggctgcttcccacacactggtgcagaagcagaggccatgctcctggatgcctgcttgcctgatgctagttcttctctgtctcatacacgcagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggtatggggcgggatgcgctgcctggggatgtcccccatgtgtgtgggtgaataacacgtgccggttgttttgcaggggtttgattcaggagatgagcggcgatgcttctgtgtgcccgggtgagtgactcctcgacgtcccatttcctttgggagtggcgaggtcttgtagccatttcacggtgcttcagttctgtggcatttgtgtgtgttttgtttttctttctccactcggaacagaggtcaagtgttctgtagcagactcgtggtcttctctgtctttttttcttgccgaaagagtacttgaagccacttagagtgtatctgcttactgggaagcagtctccttccaaaaccatcctgttttctttctgcttagcttggggctcattaagcaaaacctaagcctgttataaatggggagaaaggagcccatgagtgattaatcctcaggcagtgtaagggctggggtggtgtttcccctggggctcccacctgggattcacccgcctgtggatgtctgaaatagcaccaca

SEQ ID NO: 16620 - DNA, 1241 bp, Homo sapiens
cgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctag

SEQ ID NO: 16621 - DNA, 1378 bp, Homo sapiens
tagccaggatggtctcgatctcctgacctcgtgatccacctgccttggcctccaaagtgctgggattacaggcgtgagccactgcgcctggcccacaaagataattctttgtgtcctttactgttctcagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttatattgaagatctaaataaaccacgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggttattatgttgatcccataatataaatcatatcctttatattttagaatatctcaaatgtattccttttttgtatggtgggtttgcctagggacgtgtaactacaggcttttactaagccaaggaaaaagagaatttttcttttcatcttacaaattccagatatctacaaaagatgtgaaagcactaaaaataccatttttaagcagtactttacctgttttttctttagcaaaccaggttatgtggtgtaaaggtttgttatacgtgccacaatatagcatataaatattatgccatcattccttctcttgttaaaggtagaagaataaaattgtgatttttataacctgtgcttattactcaaatggtcttcaacatcttt

SEQ ID NO: 16622 - DNA, 1411 bp, Homo sapiens
ggcatgattgctgtctttctcaactgatataccatgtgacccaaagtccccatcctaaatcatatacttggtctttctgtcctggccagcactaccctgaattgtctcattagcaacaactgtcaggtttggtgaacatacccaccatgagaaacaaagattcctaccaggaaattccaaggatttagaggttcacctcaggagctgggacaaaaggcagaactcttaggataaggccaaattccttactacacaagcagttaacatttttttaaatattcacccccaataggtaaaatactgattttttttcaactttttctttccattctagaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaatcccaggtgataatttgagtcctcagagaagcagatgacatgacaaagttagatgtgcaagaatttattagaggaaacataaatggaggataaacgggagatggagcaagcgtaggtcgagagagccttcagactgcagtgtgggtctgacacctgtaaaaagagaaaatgaagattgattagcaaaaacttagactgcagtgcaactctaagatgaagtcttggtcaggccaatggagagttcccaagcaaggattccttttagtagagttcagaattgggcagaaatagcctggctttgtttctctgacttcctcaagtcagtttctgggaggagaccaaggggagcgtggccttcgcacaaatgccttgatggatctgaaagtaccaacta

SEQ ID NO: 16623 - DNA, 1068 bp, Homo sapiens
ggtgcagaataaatcaacatcaggggtcagatagtatttttaaccatcgtgacctgtgggaatatacatatggcacaaaatgaaaaatgacaatcataaataagaatcatgaatacaaaggtttaaatctagaaaaagacaagaacagattgcctggtagagttctatgcctggaccatagctaccaaggattgccaaaacacatgccaaggatggagatgtgtgtgtgtgtgtgtgtgtgtgtgtgtgtagtgtatatattgcatatacactatatatgtatatatatgtatatatatccatccttggtatgcttttatatgtatataataagctatatatacacatatatatagtgtatagttgggggaaaaggaaaaatattagggcttgaacccctttgtatcccttttcctccaaatgtaacattttctttttagttttatttgtctgattgaggtgttatttttgtggctttttaggtggagtattgctcctggaaaatccaaaaggtgacaataggttggaccttttaaagctgaagagtgttgtcactagcatttttggtgtgaaaaatacagagctggctgtcttccatgatgaaacaggtatgtggaaagtgagaggagcctacgtcctttgactcaagatggattggtgaaggtcttaatttgctgtcagttgtactatacaacttttgcatttttcctaactctcttgagtcagggcccaactcttcagcagtgcctgcctgcagtgtctattcatgcctcctcattgtgtcatgtgactgaaaaccctgggcttaatggatctaatctttccctctcacctgttagctagctggtggacttcaggcttcagagtcctctgttgtgaggttgtttttgtttttgagacagggtctcactctgtcacccatgctggagtacagtgatgcagtcatggctcactgcaccctcggcctcctgggctcaagtaatcctcctgccttgacctcccaagtaactgggactacaggcatgccaccaccatgcttggctaattttatttaatttttttggagag

SEQ ID NO: 16624 - DNA, 2810 bp, Homo sapiens
ctacacactgcccgtctcattttagcctcaccacaccttgctcagcaggtagcagaacaccatgtcatacaaccagcaaatagtggacctaagttcactttctctttaaagactgtattttcttcatgacatcctgctgctctgtgtttatggtgagcatttgttgcctcttggtgccttcccttagctttgtcatgtctttggacctgagagtttatataaaacagtagatactggtgatgacttaactgtcttcaaggtagcatagtgtaatctaaagaaagtttgtcatgtcttggctacaaccatgacatgagtcagagggaaatgatctcttgaagcctctgtggctttgttattgtgaaattttaatcaagaaggggcataatacacgggtagtggggcagcttgaagaggaggggaagctgattaacagtgtagctgcttctccatagggaccattgttgtggaaggccatgaattgcacgatgaagacatccgcctcatgtacacctttgatcaggccacaggtgggactgcgcaatttgaagcacactcagatgctcaggtatttttctgtttcctagaacatttctttaccaagagatgagagcataagaggagaaagtatttgcctgtgcctttcctgataatgttgacagcttgtctcagggtaaaataaaccagttacttggtttagattggctttattaaactaatatattattatgcccttaacatatgcatttgtttagtgaatacataagtaagcattttgtgatttctacatgtcagtcattgtcccaagtgtggggttgcacaaaaatgaacccttcaaggaatgagtcagtcaaggacacctgaaattaagccagttcttagtattctacctgataagttatctggtagaaataagtacacagagggctcctatccaaaaataggtgtagggtgaaaagtggtcagggaacactcttttcaagagaatatacaaactgttttagattccaggatcaatattttttgccatattggagaagagactatctctttgcagtcctgaccagacatccccagtcagcatagttgtaagatctcgcatgtgggtttggggatattgcaggggtccctctgtgcttagcataccatgtgcaggggaaggtagagcagcacctccatgaaaggaaggtcgacctcctcagtcctttacccaggcgcttaagttagatgtgtacagaactctacgtgggaagacagtggcaaggagtcggaggtatcgtagctgggaaagaaggcagggaggaggtttctaaacactgacagtgggcagttcttcctcattacagcagatgttaggggcctgaaaagttgtccaccttacaaaagtgtcatgtgatgcttctgagtttcttgacatggcttacatgttgtagtggccctgcactgactggaattttgagtttatcatgcatttcactacctctgatgcctttatgaagtgagtcatttcttaacttctctgtttactcaaaggtaaatgagatgatgcctaatgtacaagtcttttgtagagtatattttactctgcaacatgctgtgtaacagaagcgatagtgtcattattgctacatcataatcagcaaccttcagaatagatgagatagaaacattaaccttagcaaaaatatggcagtttaagtcacagaaagttttgtggtccattgtagaatttgtcttgagtcgttctgacaaacctgaagatcacaggggtcatggtataggaaagtcacttggagttgactgcgctgaggccgttgatccacttgttgtggcctgaaaagctgtgctgctccaagggcttcatgattattgatcttacttattagaagagttgatattacttcttagatggccaaaaagcagagtcatgtgagggactctgataagaggtggtcccagggcatctcctgtgagcagcaccctacaaaaaaacaagaaacaaaaacctgcacacctttctccagagacagaggactagctgattatgaagaagtacctgaatgataaactagattaattttattgcttttgctcatttgtgtgaaaaaatagtgctgcattatagactctccagatttaaataacattttgctgagttgggaagaagtgtttctccttatttgattgtcatggtgtgcactgttcattcccacaggctttggtcctcttagatgtcactcctgaccagtcaatggtagatgaaggaatggctcgggaagtcatcaatcgcatacagaaacttcgcaaaaaggttagtttgtcagttaagaataagctactgttttggctttttgtttgttttggttgtttggagaagataggagaggcaggtaatataaaccatagtgatcaatgcataacaatcactaatccatagtccatttggaatgtattctgcagaaaagtcactcctcttcctctccccacgtgttcactcccaagtcgtagctttcagccagcctgtgccttttcccatccttttttttagctccgttgggcttctacagaatatcccctgtgactggagcagaaggtaatcagagctgatagtgtctttgcagaagggcagaggtgcagtcagcatagacaggcttctagcttaggggagattcccggatttggacagagttgggtagtttttccttattagagagctgaggaatatgcagggagctcatcctggagcgcagaggggctgcaaagcccctgctagtgagagaatcaggaatttcttgccctgtagagggcag

SEQ ID NO: 16625 - DNA, 1719 bp, Homo sapiens
aaagtggaacggctccaactttaattctttttatcctgtttcctttactccatatgttataaggctcctatttattccttaaccgaaggaaaatctgctttgtacaaggtgctgtgcctggtgctctccatgcctgatctcatcacctccatcctgtgaagcagggggtattttccccagtttacagatgaggtttctgaggtgtgggacagtcagtcttctgtgcatattgacttggctgatacatcattaggtgctcctgtttctattttagacatccttcagaattctagaggtgctttgggtttttctatctacagtcctgcagctatgcttcagggatatgaggccatttctcattcacagggcatgttttgtaacctcatgctcattttggtgcctattactgtgtcattctctaacatgtttagttgtttctcagtataaatgagatcagttgttgatgactgcatataactgacatgatgtcctgtgtcttcatacaggctccctacacaccttttctcactgaattgatgtaccagaatctaaaggtgctgattgaccctgtttctgttcaggacaaggacacactcagcattcactacctcatgctgccccgtgttcggtaggactcaaatagaaataagcctcacctgtgccaaggaggggagagttgctcaagcatgtggggaagaggagggatttccctgctccagctccatctgtgccttgcctcccgccccagctgacatgaactcctcaggctgcaggatggggcccactttggtacacggtagcaaggatgcttggtgtggaacccctttgtagagctgtggcaggtggggtgtgggcatgccccatgggggctccttggggagatgccgggtgctgagtggtaggcactgcgctgcccttccccagtgcttcaccaggagggcctagccacacttctctagcctgaccctcttcctcgcttatgcatgcctagtgccttcaattttctcctcttaaatctaaactctttcatattcctacctctaccactcagagaagaattgattgacaagaaaacagagagtgcagtatctcagatgcagtctgtgattgaacttggaagagtgatcagagaccgaaaaactattcccataaaggtttgaaattttacttctattttacatggcacagacctaaattaattaagtgtttggaatgcttttttaatatagagagcttccaccaatggcctttttccttttctgcagtgagggtgtgaatgacttagtactagtccagcctgactagagcttgagattcaaataaacatttaatattccatttttctgcagttttagaggactggctgctgagtgaactttcccctcccttttcctcctagtatcctttgaaagaaattgtggttatccatcaagatccagaagctcttaaagatatcaagtctttggagaagtatatcattgaggtaaggtagatgatttgtctgtttttggtacagatagacttagaacattattttgatgaataatcctcaaagtacatattgactctataatttatttttattagtatagtcataacaaatgtaataatccatattttacactgtgcttggaatcaacataaatttgttgtaattcttttaaaaatatttcaagatcaatgaatttctttacctatcatctatcatcttcattcact

SEQ ID NO: 16626 - DNA, 5102 bp, Homo sapiens
ggtagcacataaatgaggtacataacattttacagaataaaagcattttctagtctgccttatcacttttgggtgagagtgcattttgcatcttttgtcatcaaattgtcttttccatatgatcttgtgccaaattcaaaacccatccttcatcttcagctaggtgcttctgggtggtcctgagaggccacccagtgctgccatgtggctctccacacagacttcctgggagctctggtaacagagaaatggtcagtaaatcattccagacgtttatttcaatgcttctttcaaatcttagacagtaatttgattggtctccagtaaccaggattaagaatcattgctttaagtgattctcaagaagtgtgacttatcaaaaatagaaattcaatgaataaatacagtttctttcttatgcttggacttcatttctatttttattgaactgtttggggttttttttcaggttttataccctgctggtgctggccacggccctctttggacaaccgcctttcaagaacgtaattgtgaatgggcttgtcctggcaaggtaggtcaactttgttgtagtgacgggtggaactttgtctccactgtttcttaagaaggagtgcgtgagagcggtcaactttgttgtagtgacaggtggagctttgtctccactgtttctcaagaaggagtgtgtgacagctaagcctgatggaggaggaggaaggggaggactttcagattgtgctactgctagtaacataatgctactagtgatattactagtaataaaatagcatttactaaacttagcactttatgaaatacttttgcttatagatcttatttaatctgtacatcagtcctttcatgtagattttgttgtcctttttttaacacacgaggaagctgtgggttctagagaccacaggtgcccaggatcaaagctagtgacagccacactgggcttgaccgaggtactctgccaccagatcccattcttcccctcatctgaaacttcctcccaatgggcattatttcccacattttgctattataaggaagtctcatttttcctttactttattacctctagtcattaagaataaaaataaacataaatgaaaattttaaaatgaaatattttaaaatagaatttgtgctgagtacccacacagaaatcctactttatatgctgtgtgaggaggaagaggatgtcacctaacattttgtgcatccttattttttgccaggccccactgtgtgcattttcacattttaactcatttaatccccagaaccatttgagatgggtcctataatccctttgtgacctttgaggaatctgagggacaggaaaaagtgacttgccaaaggacacacagcaaatgagtggtaaatgcaaattttgaacccaggcagtctgcctctgtagtatgtgtactactttttttttttttttaattgaaaattttattgagggctgggtgctatggctcatgcttgtaatcccagccatttgggaggccatggtgggcggatctcctgaggtcaggagttggagaccagcctggccaacttgataaaacccccgtctctactaaaaatacaaaattagtgggtgcagtggcacacacctgtaaccccagctacctgggaggctgaggcacaagaatcgcttgaacctgggaggcagaggttggagtgagccaagatcatgccactgcactccagcctgggtaatagagtgaggctccatctcaaaaaaaaaaagggggaaattgtattgagatcattgtagatttgcatgcaattgtgaaaaataatagagatcccttaaattctttgcccagtttcccccagtggtcacattttgcaaaactacagtatatatcacaaccaggatattgatatagcccactaatcgtattcagatttctctagttttacatatacttatttgcttatacgcatttacctgtatacggctatcgtgtgtaggatcctgtatccagcagcacagtcaggttactgaatgaattcaacatcaaaggctcccttcctgcattgccttcccctcctgccttcccactgtcatccccaatccctggcaaccactggttttttctccatctctgtaattttgtcgtttccagaatgttatataaatagaattatacagtaactaacttgggggaattggctttttttttcttttttttgagacagagtctcactctatcacccaggctggagtgtagtggcgtgatctcggctcactgcagcctccacctcctgggctcaagcgattctcccatctcagcctcccgagtagctgggaccacaggcatgaaccaccacacccagctaatattttgtatttttggtagagacagggtttcaccatgttgacaggctggtctcgagctcctgagctcaggcgatccacctgcctcggcctcccaaagtgctagtattacaggcatgagccaccgcacccagctggctttttttaaatccacataattccattgagattttagatgactgcacctaccaatagttccttcctttccatggataaatagcattctgtattatgggtatgccatggtttgtttgatcatccacctcttgaaggacatctgggttgcttctaacatttggcaattgtgaataaagctgttgtgaacaattgataataggtttttatgataatgtaagttttcatttctttgggatatattctgacacatctttcttcttcagtctaccctgaagcttcctcatggacttagtatgatattcaaaaagaagtttgcaaatattaacaaaatatcttaccattgtaccttaacactgtttgtttcttttttgagacagagtcttgctctgctgcccaggctagagtgtagtggcgcgatcttggctcacttcaatctctgcctctcaggttcaggcaattctcctgcctcagcctccccagtagtggggattacaagtgtgcgcccccacgcccagctaatttttgtatttttagtagaaacaggtttcaccattttggccaggctggtcttgaactcctgacctcaggtgatctgcctgcctcagcctcccaaagtgctgggattacaggagtgagccaccgcgcccggcctattagcactaacttctatctaagttactccttcccatttcattttgtatattcctgtttgcaaatgatttgtatccttaaaacaagatcatctgtgatattgacttacttaattggcatctcccttttgttttacaagtgatggccaaaaaatgagcaaacggaaaaagaattatccagatccagtttccatcatccagaagtatggtgctgatgccctcaggtacaaaccagtgctttgccttgtgtgtatctattgtttttttatgtaagcatctcctatactattaatcagtattcttagatttggtttatagttaggtttttagcaacatatctctgttatttggatgttatgttggtatggttgttgattttaaacccccaaaatagttttctaaataataaaggcatttttaaacctagaggtctgtttgaggaagaggacctgtgttgggtgttgttgagctgtccaagtcctccccaggctagatgctgattgcctctgccttacttcctttctaggttccctgtcttgttggtattagaattctctttcatcatttgttttaattttgtacttacagagccatgtgagatatatctatgctagaggtgataaaaaaactcatattgaaaagcttttggagaaatttgagccactgcttgaggtagctgtaatcatgaaaccacacagtgttcaagttgaaagggacctagagatcttgttcagcatccctgtgtcctaggcatgagaccagtgcccaggcctgtgactcagcaccttcacacagtacctctgttgaccaggagccattagtggggctctcccccaattctccactgtctcttagactcacccttggcactgctgcccatttgggctgtgtaattctttgtggtggtagttctttgtaggatgtttagcagcatccctaacctctgcccaccagatgtcaagactctgctctgtgaaggctcttccttgtgagtccctctctctgcaagcagcagatgcaggtcgtgtccgtgggaaggacacagtggctcttgacgaggaccaggccagcctttctcttagtgctggtgtaccccattggtcctgcagtgagagtggcataagatgcatttctgtgctatacagtgccatattttggtgtcagattatatacgtcttttataatttgctaagtctcttatagaaagtgagagtgagttttgtgagttttaaattgaccactcaaagagtattcataattacccccttttgtagaaaataggactgattttcatcttgctctctcaatatgtcgagtagtaataattggtttactgtctaagtaccttttctgtctaatttttctccctcttccagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggtatgggctgtagggggctgcacatgtacctgccgtgtctccacagcgctcccttcaccaagctgtgaggtggagctctgtgtgagactttagggctgctgttctctgctgcctgatgctggggtaacttagagccatggggaggccatacatgcaggtgcggaaggtatctagggtccgggctatgccaagaccatgggccctagcctgcaaaagagttatgtcatatagttgtttagtcgccagttgttgtttttgtttttgaggtggagtctcagtcttgtcacccagactggattgcaatagcacgatctcggctcactgtaacctctgcctcctgggttgaggcactgcctcagcctccccagtagctgggattacaggcacccaccaccatgcctggctaattgttttatatttttagtggagac

SEQ ID NO: 16627 - DNA, 1144 bp, Homo sapiens
ctatagactctggagccaggctgtttggttttgaatcctagcattgctgcttcatagctgagttacttcttggtacctcgactttcctatctgtaaaataggaaatttttggtttttcagatgtgtgtgctgctgttataaatcaaatttgatttagttttaaaacattcctgtgtggctgctctgcttatggagtagccattctttattgctttactttcttaattcctttcacttaaaaaattgatgtatgtcatctatcttctcatttagtggatactctgctacatatggaggtctgggaaataatatttgagaagactagactgggtgacctaacccctgtccaactgtgagggtctgattctccgaatggtcttgagttaccttcagtttacaggacaaagttgatgaaatgtatatgttacaatatagaacaattatcttgggaatctattacctcatgctcacacccatacatagactgttttattcttccctctcttttgccttttctcaggaggactatcgggtctgtatggactttaacattattcggaaagactcactccctgtttgccctgtggatgcttcaggctgcttcacaacggaggtgacagatttcgcaggacagtatgtgaaggtctgtaatccatatagcatagaagggtgactgttacttctgattagtctctaccatcatttataattgtattgtaattcttctaggaagttgtttttatttggttttgtcatcgcatgaaatccgtaaagacagatgttatcagttacgttcagagggtctcatatctttagaggatgcatgctgaaatttcatggggaaagatcagaaaaactccagttcatgcctcatgaagcacctttgtgaccttggggttgtcatttcagatcgaaaaactttatgaccttaaatgttgtggaatgtacttgaaaattacttaaagttagtgactaaaaataataaataatatttgttatttgtgccttttattcataacaaggtatcagattctagtaatatattgttcctaagtattatagtatgttttaatggctaaattttaattttttttaataggatgctgacaaaagtatcatcaggactttgaaggaacaaggccga

SEQ ID NO: 16628 - DNA, 1114 bp, Homo sapiens
cctgatttaatttaggttatgcatttttggtgacaatgccacagaagtgatgctatgcccttctcaatgcattatatcaggtggcatgtgttgcggctatgtcacattgatggtgataactttgttcacttggttaaagtgctgtcagctttctgctttgtaaagttgtagtttttcctttgtaattaataagtatcttgtggggagattctttccaaatattcttttttttgtcatacattcacttattaattttaacatccatggatggtttttgccagtaataattatgcctgtgatatttgccaagtggtggttttggtagacttttataagtgaatatttatacttgtaaataacattttgtgcatgtaggatgaatgccgagaaaactggttcttaaccttacataatatgttgttggcagtatagatttacttgtaccattgattattctgttttcccaaaattttcatttgtgatgacaacagaaataaacacacattgatgtacaattataaatatcattgtctaatactgttctaatattaatattttaaagtctactgttagcagacttggccgatggattgactttgacaatgactataaaactctgtatccacaattcatggaatcagtctggtaggtttatttaaaattgtaaatatggtaaatattctattctgttgtattgataattggaaaaatgcactagcatgaatcagtttatttttgagtccatcgttatttctctgaaaatctttgggaacaggtttgtttttgaatgtagaacttttatttttatttttttgagactgagtctcgctcagttgcccaggctggagggcagtggcacagtcttggcccactgcaacctccgcctctcaggttcaagcgattctcttgcttcagcctcccaagtagctgggattacaggcgcccgccaccatgcttggctaatttttgtctttttagtagagatggggtttcaccttgttggccagggtggtctcgaacttctgacctaggtgatccatccaccttgatctctcaaagtgctacgattacagacgtgagccactgcgcccagcctgccagttgcttttcttaa

SEQ ID NO: 16629 - DNA, 1161 bp, Homo sapiens
taggcacttatacctaagtaccccatagaaggctactatagtactacctgcctttagtcctcattcacctaaaagactagtcctttaatcagtgttttcattatatgtctcctctggtcaaaaactatgagataggggtttattgccctattttactgatgagataactcaagatcaggataaataatttgccttatgtcatggaactaataaatgaaaaatggataatcaaatggaggtctctgtagctctaccacaattgtagcctttctgaaggcaggaccaccagtaaatatcaaatcaattatgtctgtcggtttcctgatcttgctgcttttctccttgaagactccactatgacaagagctatctatagaaaaatgccttaaattttggctgtttttaaatggcttgatatatttttattacctgttagatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggtatgtttgagtatccagctttataattttctgattttttttataagcattagattttgtcatataatatgttcaagtatgatgaacgttgactgtcagaccttctagttcatttctataatatttgtagtttgatttgttttgttttctagagttgcatagttgcagttgttttcatagggcagcgtggtaacagtcttatcacaaattttcaggaatatgaaattgataagacactgggaatcagaggaccagaggatgtggccaaaatggggattacagagtataacaatcagtgccgagcaattgtgatgagatattctgctgagtggaaggtatgttgggtttttttcagtagaatgaacagcaaatgtagttactaaatgggcattgaaatggtttatggtcccttgtgctttttttattaatttattttttgtagaaaaagtgttagcttccaccttcaaccctattacttaaacggttagcttaaactgaaccatctctcttctgacttctgtgtgcttaattggtctaactttcttgcatgatcaccaatagggaaaaa

SEQ ID NO: 16630 - DNA, 1097 bp, Homo sapiens
gatccacatgacttgatgattaattggttgtgtgtatcttctgagtagtgtcaggggtgactcaaaaatgtcatgcctaagtaatgggaagaatattggaaccactaatacagtagtttaaaagggaagcaattctggaaggaattatgaaattttaaacaaaacatggttttagtgtgcgtttctaaaatatattgaggcaaaataatatgaagtaatgtgaataatatgtagttaatatcagggagggtggtctcgaaattgctgaacgggaagttgaggttaaggtgacctgaaggagttgtggagcagcgaagagtcaagggcctggattataataagagggaagcaaaggggatggcatccctctgcacaacaaggttgttgtgcaaggttaacctgctctgtccctgccctgtggttgctggatgctgttgtgcatggacagctctccagtggattcgatgggccatagcaatcctgtgatttatgcatggaggctgcttctcctcagcagctgccatagcccggtcgctggtacatgattcttcctgaatagtcaatgctgttatactgagtgtttatgcttgacgtaataatgcagtgattcttaatctttggggaaagtagagactccctaaaaaacacagtaaaagctgaatgagctggccaggcatagtggctcatgcctgtaatcccagccctttgggagcccagggcaagaggatcgctttagcctaggagttgaagaccagccagggcaacatggcaaaaccctgtctctacaaaccaccccctccccaccaaaaaaaaaaaaaaaaaaagctgagtgtggtggtgcacacctgtagtcctagctacttggcgggctaaactgggaggaacacctgaacccagggaggtcaaggctgcagtgagccatgattgtgccactgcactccagcctaggtgacagagtgagccactgtctcaaaaaaaaaaaaaaaaaaggaatgatcctcttctcagaaagcttaaatcttattttctcaaaaataaaaattcagatagatattcctgaataattgttagaacagtgcaagagtggtgatgttcag

SEQ ID NO: 16631 - DNA, 1097 bp, Homo sapiens; identical to SEQ ID NO: 16630

SEQ ID NO: 16632 - DNA, 1338 bp, Homo sapiens
gactgcagcctgtgacagtgcctctcgtgcacgggggtttgttggtttggccttggctcacctcctacttttacaccttctgaggtcacacagccacttttcttctgcctgactgagcctccttctgcatcagaattcagtcagagcaaagctccccagtgacttcctgtgtcttctgagagctgcgatccaggagggtgagaaaagcatcattactgtgtctgcagagagcaaggctgtgcctagggcccggccactcctgccttgttgccaagcggttgggagatctgagggcccggacttgctcacagttccctgtggccctcactgtgggcctctaggcagccctgcttcccctttacaggcagtgaggctttccatgcctataggggtcagccccatgcacgaggtgtgcctatccccacaggcctccccatgttctgagagttgtgtgggtgtgtgacctcccccatggcccacacctgtgcctgcttcagtcctgcagaggacaccatgaggtcaggacggagttgccgaggcttgaggacatgccccatacaggttggacaaggggccagcacttactgcgccctgaccccaggctgtctccagtctggcctccctgctcttgcctgcagagtactgggctcccatcctccacaggcatcttggtgatgtcacttttcatccggtgtcaaatgtgctttgtatttctatctgaggccatacattcccagtgaagcgaagctcacccttgggagcgcttcctgttggagcccagtaccgtaagccctgcttcttgttccctccacggtcctacgcatcctggacatccctttctgggttgcagaggtggacttcggcacctcctgcccctggtgactgacagaccccgggcagccttctctggctgggacagagctggagctggagctgcgggggtaagctaaggagggtctacagggagggcagcctcttgagactggacatttgggatcccccatggcccctgcctgggagtcatcttcacaattcggaagaagctggagctgagcattgcttctagaaggcatcctgaggggtgacccctgctgctgttgtctttttctgtcttcccttcccatgaaagttgtctgatctcagcttcaggttatctcctcagcctgatggaagacttgaccttggtccttgtcttttgacagatctctggaacagctgattttgtgggtgatacccctccagagtgagtcctctgtgggtggcgggaaagtctctcctcatctgtcctgaaaggctcttgtagttagtagctttaattccacccataaggtgccccct

SEQ ID NO: 16633 - DNA, 1198 bp, Homo sapiens
gaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagcacatgtttgttctctgtggttgttctgactccgtgctccagataactgtggtttaagcaaggcacaataaatccactgcctcaaacaacaacagcaacaagcctatcaggtaaccctggtagtgggaactggaagcagcctggggtccaccttcaggagaatggggaggggtcatgtatatgtggggaggctgtcactccatccctgaaacaagaatgtgttcaaggacccagaagatgagggtagggaaagggtagagttggtgtctgggtgcttgtgccaatcaaatacaccaccaggcagaagtgagccaggccacactgggccacgcacatgagtggagtggagggcacagacaatgcccccccctggaaagatgcctgccccccagggccctgacgcctcataactctgtcctcaagggtcttctgaag

SEQ ID NO: 16634 - DNA, 1247 bp, Homo sapiens
actctccccaatccgcccctcacccctgctttctgggcactgtgcgtgcttgctctccggtgggggagatgggacaattctcagctgtgagccgactgtgggaagcaatgctgacctttgatcctactcagaatctggaatctggagatggccatgtgacagccctggaggtggctcagcaacatcagctgggacatggggttttctctctgtttcttctgtcctcatccatgttggcattttgtccctagtcttgcttggcctcatggctacagtagggctgccacagctccaggcatcacaaccacatttgatggtgggaaacaaatgggtggttaggtgggggccaagcagccagaaggtccatttttcaagtggctttgttcatattttaatccataaagagaaatatttaccagggattctctggtctccttggttagcatgtgtttgtgtggccaactgtaactgtgcttgtatctgggaaaagcttgattggtgtagcaggttatgatctgttctctggggctgggcatagtgagtttctgggtttctgttggtcaggaggggtggcgggctgtgggtggagcgtgcctgctgtgtctgtcttggttaccttgtccctccaagactgtcagtgtctgtgtgtgctagagccctcctctgcctgggcctgcagagaacagcacagcacacatgcccgctgcatctgcaggctcctccctgtccacagctcccacacccaggcatctgtgggccctgatgattttccttccctcctgtgtggccaccccagctccctaccctctgtgccaaccctggcaaagctttttcctctctgccaacaatccagttttcatttagccccaacattttattttggaaaactttggaaaaaccaacagagaagttggagttaccagttgttagtgtttaccactctcctgtatatctgtgtctgtgatttcctgacccatttgcagttcacccctgagtacttcagcctgtgtctcttgataggaacgaggatgctcccacatcacctccaccccctgccgtgctccaggcactccaggataggacctgaggcactcagtgaggtctcagatgggtggactgcacttcctagggaagggatccaggagccagtcaaggatcacgtgttgtgtctggttgtcatgtcaatttcaatccagaacagtccctctgccttttattattactgttcttaaatctgtcagcattgt

SEQ ID NO: 16635 - DNA, 1217 bp, Homo sapiens
ggtgccccccagctccgttagtgctgaatccagactggagtaagctgccccaccgtgagccgttcctcctggccatcacttcttgctgtcttatctccagagggctttgtgcatagagaaggaagggatggtacatattggatagcagggtggtgtttgattagacagtgagtgggaagaatcgcatccgtcctgtggcccacccgagtaagtgctgttggtcccagcaggtttcagcggcagctcagagcccgctggtttgcagtcaggtctgtttatcagaaggccgagggccacaccagggagcaggagggggaccttgctgtctgggctttcctacctgaagagcctttctgggcacagttagtggctacagaggggtgccttgtgacatgtgagggtcactgccagactcagtggctgtccctgctgtttggctggggaagggtccagaagtctgttgatgagctgggctggccaccccatggggtaccctgaatgcagcagctggggtgtcttgtctgtccgggagggaagtggttacctgctaggctggggcttggtatttctgaccctgccactggctgccaacagagggtctcagggccagcaggcccagtgaatgtggctgttccttccagccctgagaggtgagaagtttctctaaaatttcagccttctcaactccaaaatgggggcagaagacagagggtacttgcactttccaatccatggttcctccttccccacttgtcttaccttttactgccaaggagcttttagagagagacgagaacagtgagaaagccaagcctaagccgcagtcgccctccaggaggcggcaggtgtcagtgcgcgctctgaggccctatgcacactctgaccgggggccagatggggcaggctgccgcaggccccagtgggtggtgggggcctggctttgatgctgtgtgtcctgttctctgacccttcaaccaagcttggcaggttcatagacggagccccgttcctggcctttgcacacaagtagactcttccacagaaaggggtgtgagaatgaccattcctgtttgtttctgctcactccatctgctaaatgtgctctgagacagggactccccttggggagggtgtggtctggagaggggtgttcccatctcggcctgggtattcccagacacacctgggcacggccccctcagtgaaggcagcgccgg

SEQ ID NO: 16636 - DNA, 1211 bp, Homo sapiens
ttattttttaaattctgatgatttcacctgacacatttgatctactttgaagaaattgttttgatttcattgacagtgggtggcttctttctgtctcctttctcacagaactctttattttcttgtgtctttctccccctctctttcttgaaaatactgtcatggggtcagctggctttgtgtattttcaagcaaggtgatctttgagcttgacaagaattgaaaattgatttacagtctagatgggatcataagttactgacaggagatgatttaaatgcgatttcccacagaaatttcttagtggagcaatgtgttgcaaactttattatggcatttttttgactgtttggctttcacggatagttttcataaatgtgatttttcagcttctgtgcaaacatttctgcttattgagcttgttgctacagtgttaccctacatctgatgaagtttttttctcgtttgccaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggtaggtggagcagtgtgaaaatattttataagggagtgaccatatgataagcacattgatcttttaagtgtttctgtgcttgaatgttttggatatgtatcacacattgaaaagaaccaaggcgtgggctcttccttagcattccttgcttcgtattattttttggcatagctaatgtgctacttttgttcttaagtgtttgttgaggtattgttctatccaggaattgttcagattaattttgtgaaaaaactcatttaaggttttggaaaactaacattctaaatcacagatgtcaacacatggtcactatgtaaattagacatttaaacctttgacataaattatgtttatagtagaagaaaatatgctatggggttagaatggttatgttttcacctcattttcgggatactcactactttaaaagagaaacaaaaataagctatcgtagcttgtttccaacacctacattttaagtaaatgtataca

SEQ ID NO: 16637 - DNA, 1111 bp, Homo sapiens
catggttttcttttgttcttggttttggattaaacataaaatgatgtagattttattttgattctttgagcatatgctttggccacagcctgccaaatgaactcttcctaaacatctttatttaggcaagttgttaagcagttgatttggaatggaattgcaatgtcattaactggagataatacagtatatttctgtgagtgtattgtaaattcaacatgaaaaatgtgcaatgttattctgctttcttccatgcaaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaatgtatgtactgtaacaatccattgtttgttttcctcggtacctcgtaatctcttgtgcattttctaaagccttagaagaatcatgactgagttgaccccgagtgcctctgtgtaaaggaggtgggcccatcatcggggcagtaggccagggtaaaggctcttagaaaaggaggagaagccacagactttcttcctcagtaacattccaataatgatgtttattcagtaaaataataaaacaggtttacactttaaagtgaatgttgatctgaaagcagacttgaattgccgccactctctgtaattaccacgtcttggtaatcaggacgagtgagtttctgtgctctggttttcatgaagcacagatctgctctctccagaaggccagggtcctggagaaaacttccagcaggtctctggttggccatgtttgtgctgttggagtgccaccacgcatggctctgcagctgtagcgaaggtcgtgggactcacggatcgtcgcaggattgtgatgatttgtctcggaatcctctgagacctgtgcacttccagctgatcaactctgggagtggggggtgcaggtggaaacactgaaaaggattgtttgaaaagttggtcaaagatgaggtcaaagcatttttctttatcttctagtgggcctgtgtaatacttggaga

SEQ ID NO: 16638 - DNA, 1107 bp, Homo sapiens
tactggccctatcttcggttatttacctgctccatggacctgcagctgcagagtggccaggcaatggtctttgcttttcatctcgggatttgtctttcttatttatacctagggtctgcctcctggctatcctggcttgaacaaaaaaatgaatgaatcctgaaaattggtacttagaatgtacttccagggtttaaatgtttcacaagagtgaggttgtatcaaaaatcactgactagctagttttcagtatccacaattcagtgtgctatttttaattattctaaagtaaaacattctgacatcctgttttcatttgtaatggtatcatcaaatgaaagtagaaaagtagaaaagctgaataagaaatcacatgggtcttcttagctcacatcatccgggatttacctagaacctcccactggacttgtctatatgacgggcgaccactcagtaatcaccaaccttttgtttctgcccctcaccaggtacatggtgcagtggccgggagcacgcatccttcggcgtcaggagctagatgccttcctggctcaggcgctgtcccccaaactctacgagcctgatcagctccaggagctcaaggtaatttatcagcctcattgcattgtcttggacagtctcactttggattttggtgtaatactgctaactttcaacaggcagaattgctaattctttaaactaattgctttagtccactaaactaataatactaatatgataagaacttgatcaatcgccttcatggcaaaaggaatattcctttctagttatggatttgctatccccagtttggaaatgattagtcccactttgtcagagaatgatttccccttgtttaccattggatgtttattcttatttatcacatcatgaaataaacttgccttttatattttagggggggattccaaaccctgagagggcttgatcttaagaattttctaacatctagcaaggattctttttcttatttcatttcattgttcctaattacaactttagttttctctaaaaaatattctttgcccctcaactattataaaatcccttataaaaaaccacttgaagaacgatgttacatca

SEQ ID NO: 16639 - DNA, 1538 bp, Homo sapiens
tttgatcctggataatccacaaactaggcctttcacatgcagatgatcaagagttgactgtactcgtgttaatgtttctcactctgcttatcagacactagaagcgtgggctctacgtatagaaggtaggcacccagcacttaacactgagggaagtaaaagtctgcacaaattctagtagtatgtatggttcaagaaccatatttttgttgtcttctttcatttataagctatccatttctccaaaagacattttgacagtcttattaataagttgcaattaaaaaccttgacatataaaataatgtgaacataaagtataaatttattttagaatgtaattataccaaataatcttttaatgtaactatttaaaaatgcagaatcttaatagagtgttcagttttgacactctttctgttaatacgttacctgtgtgcagatctgaaatgtgaagtgttattttacgaagagattgtggagccctgggctctaaggagaccacacatcattgctcattttgtcacacgtcagccttaagtacagtgttactctacactgcggaacgctttataaacccaacctgaaatacttgagtatgtttataaaatattctcttaaattcaaatgtgttaaatcacataagtatttctgttcaaatgaggccagtgttaggtcaatataaggtaatggtaggactacttagtggtgctgttttgttgaggaatattctgttaactttggagagttttactaagactttgaaagaatttaatactgtagtactcttattccatagaaattactcttttcaatttaaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggtatgctgcggggccgggtggctgcctttaactgcaatgaaataaagctcactggttaaatctgtcatcttttataccatatttatcatcctgtgtttcaagattctgttttaggttgggcctggtactgagtgtcactaaatatcacttcagtacccaggatgagccaagctcctgatataacattgtttctcattatttgtggtagtaatgttctaaaattcaccttgaacgccaaattagtgaatactgaccattgctcctaggggcaatacaaggtgctgggttccttcaaggctctggtcacatatttttgttaaccaatcagtatataatcttatttcatgtgcattttcgttaaagacaccttatataatatggattgttgattcattattattgaactcacagccagtagcttctgtaacacgtatattctctgtaaggcacatcacagcctccttatgcatttaggaacaccagacagcacttcagcactacacttg

SEQ ID NO: 16640 - DNA, 1132 bp, Homo sapiens
caggtgtgagccactgcacacagcctttaacatcatttataatgtttgcataggatcccatttatagtattatgtaattatttaattaaccattaaataattaacaattattaaataattaaccatacaattttcaattaaccaggtgccttaatatttttaaagtattagttttcaaatcaaatgcattggatatgggagatgtagctcaggggtagagcatttgactgcaaatgcattggatatgaaccaaaaaaataagattgattccttggaataaatcttccctatgatcatacttaacctgtttacgcctagtgttccattattggaacgcaaagcatgtgggagttctttatgtcctactgctcaaggtctgactgcaaaaattcaacaaattgcaacttccggcataaatgggttaattcagtgcttcataaaacgtaagattggatggctttaaaatcatttgatactattttaaatgttgtctgtaacagatttaagtgtttactgttgtcctttttcattcatttaggcgtccaagaggagttatttccaccccagtgattagaacatttggaagaggtggaaggtactatggcagaggttacaaaaaccaggcagcaattcaggtaagaagacaacatgatgtttgtgccagttcaatgccctcagggatgtctcctgtctgagcttgcacttctagtacctgcgctcagacagaagagctgtgagggtaatgctttagctgtcaagtgtctaacacagtaactggcacacagctgctcaccaaatgtccattccctagagcccagatcattttgctgttaagtgcctcttcaggttgtctctcccctttgccatgaccctgtgtctctggtagcttcccgcctggtgtgacacgatgggcttggcttaccttgggcattgcctagccctgacagagctggaacagccacttgtagtttctttttttttctttctttctttttctttttttttttttttttgagatggagtctcgctctattgcccaggctggagtgccgtggcacaatctccgctcactgcaacctccacttcccgggttcaagcgattcgcttgcgtcagcctcccgaatagctggga

SEQ ID NO: 16641 - DNA, 1945 bp, Homo sapiens
tggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctttagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttagtataaagtatggcgtggcttttaaattcacttgtaaaagctaattttatagaggtttaattcaaatcgaaacaactactgaaaagatcagaaaaccaaagttgaaaaatattttaccttttcaaagtaattccaggtttccggcttagagggacattaatatatgattaatttgtttgatagctcagtttcaagcaaccaaggggataaaaaaattctgtttgataaagcagacttacagaagaggtttttttaagccctgaggaagcaataaatttgactccaccacgttttaaaagctggatgttacaagtatagtccgtttttcatgccatccttttgactgaaggctcttctctgcagcctgatatgaggtccccgtacccaggtccgccgagcgcctggagaaagcgccccgtgctgccctctagcgggggatggtgggctaacggcgccggaggcggccaggagagctgcggcgatcccgctccagggagggg

SEQ ID NO: 16642 - DNA, 1191 bp, Homo sapiens
tgcaggaggaaggtcactgagtcggcttgctggctttaaggtgtgagagaccagtgcgtgaccatatgagggtctggaccctccttcccatctgctgtcttccgtctcctctccatgcccatctctgtctccaggcctccagccctccctgtggcatatgggtggatgagcagagctggatgaggggagtggctggcctcttccaagggagaagtcatcagctcactgccaccctctctgctccacgccctctgcctgccacctgggccaggagtttgtgcaggagtttgtgcaggccataggctgttgtttaagtgcctgggctgcaggccaagagcactgggctgagtgcctgtctctctgtgcccctagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacggtgagtgtcactcctgcgtggggcagggcccatgctcagccctagaaggcctggctgagaatggagacagtagcataaacatgcagctctccaagttacagcaggcctcagctcagcaaaaccctcggcctctgactgctgtccccggagaccctcctgtgagcgagactggccggggcccacatctggtggacaggcttgggcttcgtggtggggcctactctagtttgacaaacagaatgacagcaaagtgaactcctgttttctgggctctggaggtgtgtggcaccgggcgccatcttgcttcctcctgaaccttgggtcctgggcattcctcgacaggccccggaggttgaaggaccacaacctgcagtgagtgtagggtggcacttggcttttgagggtcacagggtcaccgcctcaccgtgttggggcagctccccaccagccacaggtcatgccctacagtgtcccctccacctagacccgccaggcagggtgggggctgtcagagcccaccctccatggacgttagacgttt

SEQ ID NO: 16643 - DNA, 1176 bp, Homo sapiens
tcccagcctgactgcatggagacctacccaggaagctgttcaaacccaggcccagcccaactcaactcagctgccaaggtggcccaggaggcacctgggctcagagcctaaacgggggatcccctggcagagcagctcgaggcagcactgggtgggtgggataggccagggccagggtacccagggacactttgagaccagctgggatgccccacagtaaaggggaaaatgtgagccagcaccgatgtggcccagggtgtgctgagatcgggctcctccctttccagtgctgatggacgtggtgtgactaaagggcacaatctgaggctaatggaaagcaaacagctcgctgcacggggaagagcctggacacacacgatattttctcaggagctcaaagtgcaggcaggagaggcttggctgaggctggggctgtgtcaatcactccctggctgtttgtctaacctcgccaagtgtgttttctccttattagcagaacacagatagggaagcagatctgcccgcagatgcgcagctgcaggaatgcgtcctcccagcagagcgggagggaggtgggaggggacccctgtctgccagccagggctgctctggagaccctgatggggctttgggaagccaggctcctctctgctgagccctcacctgtgccaggctctgggaagggtgtttacggatgttctttctgaatcctcgaaaacccccaggtggctgtaattctgaccattttccaagcctgaagctgaggctgggtggtgaggtggcccactcagaaccacacggtgaggaaggatgggggtgctggggtttgaactccactgcttctgcttcttaacccatttcagtgcctgtcccagtgcctctgggctgagcctggtctgggtcatccctggtgagtctggctgcctcccaaaatatctctgggccttcaattttcctcatcttgtgctagatcagggccagcaaactttttctgtaaatggccaaataaaaagtatttaggctttgcagctcacagaggctctgtcagtcactcagttctgctttggtagtgtaaaggcagccataggtgatatgtaataaaatgggtatggctatgtcccaataaaactttatttacaaaaacaggaagcaggccagatttgtcaacccctgtgc

SEQ ID NO: 16644 - DNA, 1165 bp, Homo sapiens
actgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcc

SEQ ID NO: 16645 - DNA, 2041 bp, Homo sapiens
gtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgttttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaattttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttacttttatgtcttgtgtcttttttttaaagcaaatagtattgctcttttgggttctctgttgggtggctttcaattaaactgagttgtaatctttcagctgatgcaaaaggtatgtattttcaaaaaaattttatttttaacaaaattccttcaaagtctcccttcaaaaacatcgtaactacagatgctccttgaaaaaaacatcgtaactacagatgctccttgacttaccgatggggttccatcctgataagcccattgtaagttgaaaatatcatacattgcaaatgcattattaacacagcttagaagcttcagcactttcggtatcagcacagtagagtattggttggttgtttaccctcctgagtgcatagtgattgg

SEQ ID NO: 16646 - DNA, 1210 bp, Homo sapiens
attttatccaaagcacttggtactagaaatatattttaaaacaatcctttttattaaatttctttttaacaagtggagctattttggcaaattaaaaaattaaaagattaaatcacaaatactggctaccaactgcctataaccattaagttgccttagaaaggtcgaaattactaaccatttgaaatgtgaaaaaactgatcatgaaaaaagcccagttctcttagttctttccatcattctcgtttggctttaaaaattgatactgttacagaaaggaaattgaccacacaagagttaagtgatcccaaggccacaagaaggacaaaaccccacaaagttaagtttagggaattctgaaggacagctaggagagcaaagatagagtgagggaaaatattcccatcagcagaaagagaatgtgcaaagtatgatggcgagaaagcaaatgttatattcagggatacttgttctgtgaacttagtagtttgagattttcctaaatataatgtttacagtgtttttatattaatgattttttctgcttgataaaacttattaagttttcctttttgtagatgaaagccaaaaaattctaatatggtgcttatgttgtctaattaacaaagaaccacagaattctggacaatcaaaacttaactcctggatacaggtaagagagtaaatcttgctctgcacttctttgaattaaattgattatttaaaagtgctgcttaaaaaaattttggggtggggtggaatccagttctatgatgttttagaaactttttcaaacatacccttcactgttacattatcttgctgagtaaaaagtttttcaagagatttcaattttgcttgactgtgaattccaaaagataccagtctttaggatgaagacctaatgttgagtggttttgaaaagtttctttcaggtgattaaaataatgtattccatttcactctagcaattgctatccttcaaaaaattgtttttccctatcaacctggtttaaattcctttccacatgcttccatgcctctctcaaaatctattttgtagtgaaatgaaaattcagcagtgcggcgggagcagcactctttattttgtgtcccgaagttggtgcctgagccagcatatgcacagactggatcttggtgctgcgcagcctctgctgctcactcacactttccagttggctacctactg

SEQ ID NO: 16647 - DNA, 3079 bp, Homo sapiens
gcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagatgattatcatcagtgaaggtgtcatacttctaaacagtgtcaaagataatatggaattgattgaacctg

SEQ ID NO: 16648 - DNA, 1217 bp, Homo sapiens
ccacaagtcgaacagatggaacaaattgacagaatcgtgttcgctcaccctgggctccagaagcagctgagctgctgtttgaagttgggggagtttgaatgtgctttttcccctctgtgtggaatttctggttgtattgaagaactcatgacttagcaccccgagtggcacgaaacggttaatgaccctggtgcgtgtctttccgtcgcactcttgccttcttttgtaattgtcatggggcgaaaggaggagagtggtttttcttaagataaaatatgagtatttgtttcatagaaacagataatctccttccccccttttgagcagtggctggcagcagctgcagttcattcatgaaagatccagtgctttcagtcaaagtggatgtgggacacagagggtgtgtttctgatggacgtctaagagccccctgccctgctcagtctcctcagcccaccccgctaggaccagggtccttctggctgcgagttataatgtgttacaatcatttgccatttctaggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccaggtactccagctgctgggcactgagggcgcttccagggctgcggggccgctgccctggtggaggctgcttgacagcgtgtgaccccaccctgtgctctctggagacctaaggcactgggagctggtagaaagaatattgggtgactctaattcacctcctcccaccagctaattgtgtgacctcaggccagccagtgcacctcactttcctcatctgtcaaatgggacaggcgtgttcctaccaccagaacaattgtcagaataaagtgcagccaagagagtgcaggctctttccaatgttagaaatgcagcggcgtgtgattctttcagttctaggactcggtaccttgttggtcttgatggtattcaagcttggaaagatggatttcttgggtagcagtcatttggatgagcagaatttggggtaggtgggtgggttaggagattggagaggtgacagaaggatgggaagatttgttacatttgagatctttgggtggccctggccccaggagtagacagatcgctctgtgatgagtgaagcaaacggaaa

SEQ ID NO: 16649 - DNA, 1135 bp, Homo sapiens
tttctaaccttttgtttatatttcctgctcatgtttcacctctgttttattaaattatgtcacatatctgtgtacgtagagaaaccctaagtgaatatttatctagtttgatatttatttggtctcatttattttgctgtttttaactacttcccttttttgtaatagcccagtttcctaggagccttggagcataaatgagaaggggtctgcatagcactgccactgcacttagattttgttaccaggcacctcgtaacagcaacatttccatcactgtgtgtcatgaggataaatactttctgtaataaggattttctccctttatgaaaaatatagttgtattatgatttaccaaaagtatgcttccacattagctatttgtggatattttgtgcaatagttgaccatcattttcttggaatttattgtgccaaagtaacccgataataaatgttattgtaagtgatacattttatgatgtaagcaggtgcatagctatgctggtcctttttattttctatatttttctggttacagaccaattctcatggtgaaacagtgaaaaccttgtatctcagttaccttacagtccttcagaaggtagctaaccatgtcgcgctactgcaagctgctagtacttccaaacaacaggtttggttagcattttacatttctttgtgatgctattgttgtgaatattttataaagttttaaaatagttattaaataaagtttttgtggatgaaatttaagaggaaactgatttgcttatttttaaatgtagatatcaaggagtatgtgcacttaagtttttaatcaaagtgaacaaatttaagcttaatttaaaataagaactatcttttatgcctttaataatgttcatatctttatttttcaaaacagtctttggtataattactaaataacatatttgatgggtcagttctattcctctaataatgtctgtaatggtatttaatctactgggtaaaatgaggatttataataatttgtatattaaatattagggctgtttaccaaactggcaaaaatcagtaatttcaaagtttactttggttgtttccttttattctagagcacacataaatgaaaagatgtttttgtaatgatt

SEQ ID NO: 16650 - DNA, 1102 bp, Homo sapiens
agcatcagctggatgagccaaaactagaacgacggcctccggagagacacccaagctggcgaagtgaagaaactcaggaacgggaacggtcgaggacaggaagtgagtcatcacagactgggacctccaccacatctggcagaagtaagtcagcccaggatgcacgaaggagagagaatgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcaatcccctacaagtggtgagggaaaagtagctccagctcaaccatctgaggaaggaccagcaaggaaagatgaaaacaaagtagatgggatgaatgtcccaaaaggccaaactgggaactctagccgtggtccaggagatggagggaacaaagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaattcaccatctcctgaaaaaaaaaaaatttcagtaatacggaggaaaataatcactagattatactataattctaatatttgatgaattatttgaatgggtgcattgataatattaacttaaacaaactttaagatctacatttaattttcagttccttaatttcacataggccattagtctttcaagaaaatattctgcttagatcaagcttttccaacccacagccagcaggttgcatgtggcccaggacggctttgaaagtggtgcaacacaaattcgtaaactttcttaaaacattatgagatttgtttacgatttt

SEQ ID NO: 16651 - DNA, 1207 bp, Homo sapiens
aggctgctattctgtagaaatttatgaagaatgttattgccccagaatatggggtgagagagaactgcacttttttaatatggaaatgaattcatcgtaaagtttaaaatattttgtaaatatggactgcacagtacagggtagaaaactacatattgtgggaagctagattttgcaagtttaatgcattcattggaagcagttctcacaggaagcactttctgaataagacacttgtttgaaaaacagaatggtacaaatagccaaagaagattaaaacagattatttataagatcatttttaacaatatatattagtatgtttaacaatactgtaaacactgaagcaagcaagaaagtataaaatatgtaagatagataattttaattgcaaaatactgtgcccactaaggctagagaaatgggaggctattttggaagatgttctaagtaatggacttagaagaaaatagatatttgaggctcttggtaagatgcacaatagttcagaatttttgaaattggagcaaaatcagtcttattctatctggggctttacaactcagtataatgtttaagtttgaaaagcacttgtcatccctagcatgttaacttgggaacttttgcacatttcatatttctcatttgctgaaattgagtgattaatcttgcaaagtctaggtaacatagtaattggtaattttaaaaatacatattaagggccctgtaatgagatttggcacttggatttttactaaagggacacctgcagggttgttttgtagtgaaatgttttagatcttttgttagcaaacactacattttaattgtactgcttgtttagaattattagcaaatggaagcctccatatttatattttcagtgcataaagccaccttcttgctttacttcagagtaacatgccaagctattttgtgttcactaaatttagctatcagttaaacactgcagaaaatattagctactcaaataagtaggcttctgaaatagttttaactgcaagtgtgttaacttgtgtggtggtttgaagccatttttccaaataaagttattaaacaccactttatgtactgaagcatgaacagaaaaatcaagagctgagcagaccacctcctttatgtaggcaaaacttccatcattttggcttttgttctaaacagaactaaatgacatgcatagcatggt

SEQ ID NO: 16652 - DNA, 1171 bp, Homo sapiens
gtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaacagcctttttgtttattgtgttacttaccaagcattttgaattctggtaggcagtgggttagatcataaagcagaggtaacccggaatctgtgtaagttttctaggacggccataatggaataccccagactgggtggctgacacagaagttcatttcctcacagttc

SEQ ID NO: 16653 - DNA, 1185 bp, Homo sapiens
aggtgattccagagtgtaaccagccttgagaaccactattgaaagaagcagagtcatgagaagccttttaaaaaaattctgcctgcccaacaaaatcctggagtacatcagcccaagtttcatttctgtgcttctttattttcctagctggccttggtcgcacgggcactctgatagcctgctacatcatgaagcattacaggatgacagcagccgagaccattgcgtgggtcaggatctgcagacctggctcggtgattgggcctcagcagcagtttttggtgatgtaagtagtagcctacgtctgtagttcccagggaacatgtggggttggaatctgatggggagtggaatttcctttagtttccaacaacaacagataatctggtaggaagaagttgttcatgtatctttctggaaagctctattttgatgttatttaaatgctctaggaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccggtaatcaagccgtttctgttgcgatgttgttactgctttaactgctattgagaacctgtcagggtatggagaaaaccgtaggtaaaataataaagcagctcttggatgattgtcagttttttatatttataaccctctctaggcactttttacccaaaatagtggaaacaaggttgtgtgtccataaaactatgttttacttactcagcaggtgcataaaaggttgtgaagtgagctcttcagccagatctacccctgcccctcacccctttttgccatttcacaacagctgatttaggaaagcaatcattctcaaatagagagcttttaacaaatcaaaggcttagggggtagcagtactactacattaagtggtagtaagtacactgagattttaaaaagagcgttttcaaacttgaaagcccattaaccctcttcactgttgatgtgttttctaacaagagtgctgctgtgttgtctctgaaagtcaactttggctgtcttaaaatgtcacctgaagcttgattgtgaaagggaaaaatattctagagcttgcagaaacttggactgtgt

SEQ ID NO: 16654 - DNA, 1099 bp, Homo sapiens
cttttaaggccttattttagagcctcttttgggctatggttataatacagatagcctgttaaatcagtatttcggagtggattttttgaagtgagtgatttatttccttattatatttattctattattagatttaagaaacagatgtgattttccagcttgatatctatgtgagttccgtattctgcccgtctgacaggacattttatttaattatatttaataaaacctaacagaaggttataatttaaaaatctttccccttggatctcataaaacatcaagtatggctcttatttaaccataatccttgtcatactttattaccatgatttaaaattattatggcattatatagagaatataatgcactccaggtaattaatttttccctttggactaattaaaggttgaaaagcttccttgattttagtaagcagtaaatctgatgaataatactatgcctcagccttttattcttattctcttctaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacagg

SEQ ID NO: 16655 - DNA, 1064 bp, Homo sapiens
cctgggccgcagagcgagactccatctcaaaaaaaaaaaaaaattattagcctttgcacagttctctggtgagatggtcaacagctaatggttaccatataagtaccattagatggttaacacacagctgttcttgcttttacataacatggagaataagcaaaccattctacatataatagaactttatccattgtgaaaaattttttatggacagattgacctaggggttctcattgaagaaatgtcaactaatttttcattttcaaatcaacaaatagcattttatttcatgggacgatttataagggtgttgatttggaaatcctaggttgcaaattgctgagtgtttcggttctagaactaatgttccccaggaggtagatggtagtgatcaagtctctccccctttaactttaaaaggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggtaagtgtcattttattatagaaatttaggcagaattgggaagcatcactgtgattgattcttggatatgacatcctgctttgcaggaatgtagtattttgagagtgagcatttaacatagtgatgtttgcatttgacatgagaaaatacttagttatgttaaacttctcataaatatttttaaatggctatgtaattgtatagagacaacctaattttccaaactattttccagttgttgggcctttttttctcaaagttttttactactgtaattaggactgtaaagaatccccttcaagtttttgtttgtttattttggtgctattttagactgacatcctaggaacagaaagggattatgcgagttggtatttgggctcagagatatctaaatcaccttagctgtaaacaataggttttatcttttggattttcattttttttggtagaaaatatcttgaacttagttgaa

SEQ ID NO: 16656 - DNA, 1099 bp, Homo sapiens
agagaatggtcctcgctgttgggagttgatagccagagagtagcttctagacaccagaccttaccaggcaataacctaacagcacccattataggtgcaatatgggcatatatctccattgtgtcttggcttggagaacagctcccagagaagtatcaacccatccctggccatggtttctcttccatttctgcccgcaaatcggcttggtgaacatgggttgggtaagtagacataaagtccaccagctatatgtttgcctctagaatgaagaaggatggaggagagcagtgtgggaaaagaatatgaaaatgattgaactgcacaatggggaatacagccaagggaaacatggcttcacaatggccatgaatgcttttggtgacatggtgagtgtggcaaggattgctgaactctgtgctgcttctcagttcttcaccaaaatagtcttgcttttaacattttatttacttctccttgaagaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcaggtgagacagcgtcagattcagaccctgtctccacaggaaagccaagaaggaattggtgtcattgctgtggtagatggtggcacaacatatggtgatgggttttttgtatttttggtttttggtgttttttttgtttgcttgtttgagacggagtttagctcttgttgcccaggctggattgcaatggcgtgatctcgtctcactgcaacctctgcctcctgggttcaagagattctcctgcctccacctcccgagtagctgggattgcaagtgctcaccaccatgcccagctaatttttgtgtatttttagtagcgacagggtttcaccatgttggccaggcggatttcaaactcctctcctcaagtgatctgcccgcctcggcctcccaaagtgtggcgatgggttttttttttttttaaagaatattaaggtaattcaattatggggtactgtatttgtattggtct

SEQ ID NO: 16657 - DNA, 1188 bp, Homo sapiens
acatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttg

SEQ ID NO: 16658 - DNA, 1530 bp, Homo sapiens
ctataagaatctctgagagtattcatggcttatagaggaacacatagacaagagtatttcgttttctgactgtttatcttcctgtcagtccgtctggctgctttttaaaaagttacaatgtattatgccctgactggggagagagctagctgagcctagtccgtaatagtactaggagcaagcaggcactgctgccactgccttgaatcatgaattctgtttacatagaagttggtaagaactggattttttaaaaagctattgagcatccatttttttcatttccctttttatttttttaatgttggggattttcaggggtccattgttcctatcagcacttttttttccccttcctcttttcatcattctgcagcatgggtgggctgctgaaggaaatgttccacaagattgcttatatgctttttcctgacctaactacccccttttgtgtgtccacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgac

SEQ ID NO: 16659 - DNA, 1409 bp, Homo sapiens
ggaacactactcttgagaattttaaaagacctttagtttgagcatatcctaaagaattcaaattctagattttaacgcatttctgaagacccacgtgtgtacttctcttgcgggcactttggctaattttagctactccatattctacggatttgcaattacgccgcaatggaaaagtctggaataaacaccttctcaagccaagaaagcctctcaagttttgaggcgcgagctgggcgataggctagcacgtggcgggcacaaaatgtctgacggaaggtcggaagaacgcacgcccgcgaccctccatctcgcaacccccggagcggcccaccctcgcgggccctccgggaaggacagcgccgtgcggtggagcccggcccgccccgcgttagtggtgacctcaaagactagagagcaaggatttaaaatgtcgagcacaccaggtaaaccctggtcgacgaattcccacaagttcgcgacttgttaaccacagccacctgagggcacgaaacctggccgctcgcttagcccagagcgggtcgggaggccccgcggggccgccctccgcgggaaagccactggcccgctggggcacccggccgcggcgctaactggcccgcgccggtccgcggcggggggggggctcgcgacggcgggcagccgcgctaaacccgggagacgaatggggcaattcccacaggtcggacccacgcccacgcagccgcgccgcaagagggccgccctcaggcccctacagcccgcaaggcgcgcggccgaccgcaccaggccgctctcaagcacgtgggaggccagaggccgcccggcccacgagccgagccgaagcccgcccaaaatcccgcgcgcccggcgcggggcgggggcggccgcctgccgttgcccttttaagaagggggagggggtcggcagcgcgcccgcgacgggatgagtcggcggcggccgcggcgcgcggctcccgccagtgggagccaagccccggcggggcggggggaaacagaccgagggctcggcgcgggaagaggcggccgccagccagcgccgagggcgggcgggcaaggccaagctcgtgggccggctcaccaggcgcagggagacgggcacccgccaacatggcgctgcggcggcctgtggcgcgccccggctggcgtgaagagccgccgcccgcccacacggaggggccagcctcccggggcaagggcaggggccccgggcgccgccgccgcggcacagggggaagggcgaggccgtcgccacaacggttggccttggtcgacccgggctgcccctgggaggcaggagtgggcaaggccgagggcgaagagggagcgagagaacgggggagaaagttttatttttgggcttgaaaaatggcgggaaccacgtccttt

SEQ ID NO: 16660 - DNA, 1247 bp, Homo sapiens
ccctttcctgaggttatgaagcttctttatgggcttacttgtagggcccgttcctctcttgtagctttcagagcaacattccctggtggcttccaggtgtagaactctacagtgtatgtcagtattgtccagaaattaggtttcaagtgggcattgcaagctttgaaggcacacaaaatatgctgctcagaatgcacagactattaaaccatttaccctttctggcaggtatagggtattacaacttgtcaaaggattctaattggttttgacccactttttaagttagaaaatttatttgctgatgttagagaccagttcttgagtaagctgttattagcagctgattaggaaaacacaatacttctgaccttaccttctcctgttaattatttggatttaaacaaaatgaacatgcatgccctaatagaaatagggatcatttgatcttgataaatctttgagaactgtatttgttacttacaataccttaaatgatttctgtttctctgtgtgtatttgtgtttgtgttgtgtccattttctcttgcagcttgaactcagtgaaaatagaatctttggaggtctggacatgttagctgaaaaacttccaaatctcacacatctaaacttaagtggaaataaactgaaagatatcagcaccttggaacctttggtaagtaactgagaatttggaaactggaacttactggtcattttcattttcatatttctttatagtgggggaaattactggcaataataattggttgagaaagtggtggctttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccgaaagtggtggctttttactttttatgtaagtcccaattttaaagatcagggcctctctaattagatgtatttctgtggctttgctctctccctgcctgatattgtggtggcatccttcagaagagaatttttgggggtatttt

SEQ ID NO: 16661 - DNA, 1137 bp, Homo sapiens
tttcatgtctgtgccctaactaaaattgtaagcaccctaagattgtgttataaatctctgaatttttccctatactgccaccctagaacattaaagaccgcttgatacccaggaagttcttaatggccatttgattactcaaatgttaacatttgtttcagctaaatttattaaactgtttgattgtctcatactgtgaaaatacctggatttaataaaaattattttcaatttatatttctttagactactatgctgccagaaaaacacatagttctctgggagagtagataaaggaagagagggactaaagtctagtaacctaatataaaggttgcaaaagacttgatgtatttttctatatatgaggctgagtgggtagtggaaattgaatatagagcctagaattttacctcttcaagagatggatttgttacttatattcctttggtttaggagttgtggtttttgatccttttcttcagaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaaggtgagtaggctcagcatctggtgaacctgatgtctgcctttcaaagcctctgataaaagctattggatgttggccgggcgcagtggcacacaaccgtaatcccagcactttgggtggccgaggcagggggcattgcttgagcccaggagtttgagactagcctgggcaacatggcaataccttgtttctacagaaaatagaaaaaaaaaaaattagccaggtgtggtggcgcacacctggagtcttagctactcagaagactggaggccgaggtgggaggatcacttgaacctaggagtttgaggctacagtgagccatgattgttccccactgcactccgtctcagaagacagacagggtgtctcaaaaaaaaaagctactagatgttcttactattgaggaaaatagtgtgtgtttgtgtgcgtgcgcacgcgtgtattttttgaatgtaggcattccat

SEQ ID NO: 16662 - DNA, 1413 bp, Homo sapiens
tgtaaaaagaaacatttggaagacaacaccttaaaatcgaggaaactggattaacttttcctgggtgagttgaggtgctgctgtgcattttgcttttcttggttctgtggtcaccacttatacttgctattagtcacctatattaatctgatcaagtttacattgttttatctcctaactgtcaaaaactttgttgttgttgcctccattggcaataatctaagcaaaatgcctttccactgtcctaaagtcaatttttgttactgtacagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaagcctagttgtatgcttacatttttaaattatactctcattgtaagctcatgttaaaacaccaaagaactggtttatttggcatttttatattagtagttgttgaggggaattgcacaagtgtgtaggatctttgagcatttagatcaaatcctcattgataactgggagtaaatgaagcatactttaaaaaataacgttcaaaatggaatactctggggccctgaaaaccagtaaaatgttaggttcaagtattatgtgaattaagggaaagaagatagtgtaaagcaaaaggccttcaccagaatcccaagagatctgaattctagttctggctctgccactgattttctgtgtgaccttgtgttgactctgggtcaccacccagtctggaaaattgaaggggtgtgaccaaatggcttctgaagtcacttgtagcactgatgttctgtgacccttgctgacaggaaggtctgaagagaaaaatgggctttccactagtctgaagcatgtagggtttgactgatgggtgaacacagtatggtttgttgccaagacaggcgt

SEQ ID NO: 16663 - DNA, 1083 bp, Homo sapiens
ttgccttttctgttcctcttccttggaggtccttaaggtctctgtcagtctatgttgtttttaaagatggtgatgtcggctgggcgcagtgactcatgcctgtaatcccagcactttgggaggccaaggcgtttggatcacctgaggtcaggagttcaagaccagcctggccaatgtggcgaaaccttgtctttactaaaaataacaaaaattagccgggtgtcgtggtgggtgcctgtaatcccagctacttgggaggctgaggcaggagaatggcttgaacccgggaggcattggttgtagtgagccgagatcacaccttctgcactccagcctgggtgaaagagcgaaactctgtctctaaataaataaataaataaagatggtgatgtcatagtggttgctccagaattttttcctttttttgagaatctacgacagtcactgaaagatgtcctaatgtgtgttgtaggagtgtggggctgattgtgctaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgaggtgagtcctctgctgctctgtcatttgtcactttagcagaccaagggtcagcaggcagcctggtgacttccggcttagggccacctccagcccttgctcatcctttctgttcccagctactggagaggctagcaggcgccaaagcccagtgagaatctgtgggaaggatgccattgttttaaaaacacattgtctctggccgggcttgatggctcacacctgtaatcccggcactttgggagactgagggggatggatcacctgaggtcaggagttcgagaccagcctggccaacatggtgaaaccccatctctactaaaaatacaaaaattagctgggcatggtggtgcgtgcctgtaatcccagttacttgggaggctgaggcaggagaatca

SEQ ID NO: 16664 - DNA, 1597 bp, Homo sapiens
ttgaggcatggaaaaaaaaaaaaaaagcggcacaggctcattttagtcccacccttctgtgtccagatttcctgttcccccatcacagaatttcacaatggccctgaaaaaccatgcagcaggagcattttatgcagagagataaggttctctaggttggtttcagttgaacacagtgactgattcattggagttttcacattgagatatagtgacctccttaagtagctcctgtatgaagtaaacattggttattcataccattgtcgtcttgtgatgattgatggtgagatgtgtcctacccctctccttttgaataggcttcagtgtttacagggtgcttatgaaccccttcttatgtgatcatcccagcaggatgggctgtcatcctcctggaggcctcgtctttggggtgggcatcttgtagctgctaagtgatctgactcccagttagaggttctttccttgccctcttttaggtgatcagatcactttcctgtgtcatctgaaaacagtttgttttcttattcgatgagtcttgaattccaagacgaaattttatttcagacaccttggtctgtaggagactttcccaatggagatgtcctgatttagggtggaagaagtggagtctccatggggtcagtgatttttgggcagagctgttggttttgtctcctctcccctccccctcccctcccctccccttccttttccttcccttctcttttcttttcttttctttccaacagtatctcactttgttgccagactggagtgcagtagcgtgatcatggctcactgctgccttgacctcccagactcaagcatcctccaacctcagtctctcaagtagctggaactacagacttgcaccaccacacctagctaatttttaaacaaaatttttagtagagacagggccccccatgttgcccaggctggtctcaaattcctgggctcaagtgatcctcccaccttggcttcccaaagtgatgggattacgggtgtgagccaccacatctagcctcagtcttcattttgttcctggaaggaacacttagactttgatttaaatcatgttcccgcttgacctgcccacgtgctagggaatgagagaatgtgagactgtttgcccttccatgtccttcttaaatgctcagagactgagctttgtagttaatgttggttttgttgcccaggagcaaagccatgcctttgctttcagtgaatgtaactctagcattttttcccaggaataaggaaattgtgaaatatctgctaaaccaaggggccgatgtcactcttcgtgcaaaaaatggatacacggcctttgacctggtgatgctgctgaatgatcccggtaggtaatttcaagaaaagggttgtaaatctacccagcgtttcttggactgggagtcaagacaggcacctcctctgtgacttgtgttttaagcacttgcttattcgtgggggaaagtcactctcaagtgtcaggagcttactgcatgatcttaggcaagttccttccctccccagtgaagcgctggacttggaccaggtggccccggggacttcctccagcaccaacctccta

SEQ ID NO: 16665 - DNA, 1217 bp, Homo sapiens
aggattcatggcttcaagatgagcagtatcttgttgctcctgtattatacgagaaaagttagtttatccattgattggcttttattttggtcattttccaaaaaaggattttggaagcttgaaataatagcaaattcagtaagaccaaatctactgaccacaaaagataagaatcagtaagtcaaaaagggaaagaaaaagagaacaattatccgtaagtttagctgaggaaagctttagaagttgaacacaatacttagctctgagttttctggtaaccaaggcaagtaaggaagactgataatttgcatagatctcattgcctatcgagaattcatgaggagactgccaccttccttaataaagtggagccccaaatgccaagattgtcatacagggagaatctccaagtggtaaggggttattgctggatctggcaataatctgattcttgttctgaggcttcccctttaacacgtattgagggttcaatttagtgctgctgcctccatctttcttctccagtttaagtctctgatccaagtatgaacacattagtctttccctaatgccaatggaacagctgatgtaaggctaggacatttaaatcaagctttgctaaaagctggaggataatgaatagagagcaacatgaaactatttagtctggcttacaaagacatttttctcatgcccttatcttttggtgtgtctccatttgatacacttcatcagagtactgctaccaaaggcagagccagacatttaccttcaaacaggtgcaagtcagtaagatccagagtgtctttgcttgggtttcttgtttgaagaactgcttcatttctgagtaatggacgttcggaatgattactttaggagagaccacacttatctgagagtgtggccctactgtactggtctcacagtaatcccagtattcatggaaaagataggcacgtacattagcatgagggcattctgtggttagaagcattctgatttcattgggaaaaacaagcttctctctgttcttgagcagaagcttttatagaagtctttgtacatgggccattgaaaaataaagtgaacaattcgggtttatcactcatgatttgtaaggattcacttttccttttttctgcagttgctgtactacttcaggtctgttccagtgtttccttgttctcaccaccaagactgaacctccttatttttgt

SEQ ID NO: 16666 - DNA, 2104 bp, Homo sapiens
tgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaattt

SEQ ID NO: 16667 - DNA, 2190 bp, Homo sapiens
aaaattaatttcacccttaaaaacatttttaatattactagatttctattagacagcactatacaagaggaaatcactggacttgaagctttaaatgtttagcacacatctagcaaacgtctgtagccttctgtacaccaggcatatggtactgggtgagagtcttggggaataaaacagaatcagacattgcccatgaggagcccacagactagccagacggggtgggtgtctgtgtttttggtttggttgaagttgagttgaccactttatccgctgttgatttttgctttggctaggtgtctgcctgtatcccagtgttcaggctggctagacggcggaagaagatcctattttactgtcacttcccagatctgcttctcaccaagagagattcttttcttaaacgactatacagggccccaattgactggatagaggaatacaccacaggcatggcagactgcatcttagtcaacagccagttcacagctgctgtttttaaggaaacattcaagtccctgtctcacatagaccctgatgtcctctatccatctctaaatgtcaccagctttgactcagttgttcctgaaaagctggatgacctagtccccaaggggaaaaaattcctgctgctctccatcaacagatacgaaaggaagaaaaatctgactttggcactggaagccctagtacagctgcgtggaagattgacatcccaagattgggagagggttcatctgatcgtggcaggtggttatgacgagagagtcctggagaatgtggaacattatcaggaattgaagaaaatggtccaacagtccgaccttggccagtatgtgaccttcttgaggtctttctcagacaaacagaaaatctccctcctccacagctgcacgtgtgtgctttacacaccaagcaatgagcactttggcattgtccctctggaagccatgtacatgcagtgcccagtcattgctgttaattcgggtggacccttggagtccattgaccacagtgtcacagggtttctgtgtgagcctgacccggtgcacttctcagaagcaatagaaaagttcatccgtgaaccttccttaaaagccaccatgggcctggctggaagagccagagtgaaggaaaaattttcccctgaagcatttacagaacagctctaccgatatgttaccaaactgctggtataatcagattgtttttaagatctccattaatgtcatttttatggattgtagacccagttttgaaaccaaaaaagaaacctagaatctaatgcagaagagatcttttaaaaaataaacttgagtcttgaatgtgagccactttcctatataccacacctccctgtccacttttcagaaaaaccatgtcttttatgctataatcattccaaattttgccagtgttaagttacaaatgtggtgtcattccatgttcagcagagtattttaattatattttctcgggattattgctcttctgtctataaattttgaatgatactgtgccttaattggttttcatagtttaagtgtgtatcattatcaaagttgattaatttggcttcatagtataatgagagcagggctattgtagttcccagattcaatccaccgaagtgttcactgtcatctgttagggaatttttgtttgtcctgtctttgcctggatccatagcgagagtgctctgtattttttttaagataatttgtatttttgcacactgagatataataaaaggtgtttatcataaaaaagaaacagtattagattttggtctccataatctattttggtattgttacgaacatggatatgacaaccaaactggaaatcagaacactagggtaaagtggatattgaaatgaagcaagaatattgtcacacatgtgttgtgcatcttgtttagggtatatttcttaatgtcatctaggtcattagttttgttaatatttgtgttgtcttgaccaagctcctactaagtataggacacaaatgttttttatcttccaaggcctggctcaaatgccactgctgcaaagctttctttgaccctctggccacctcccaagccagaagttatcttccccctccatgtactctagccttttcatgacactgatattttcgtgacactgacttatagttcactgtttacctgttggtctaacagca

SEQ ID NO: 16668 - DNA, 1096 bp, Homo sapiens
caatatacaattaaattattttttgctatagtcacgttggtgtgctagcaaatactaggtcttattcagaaggttgtctttaaataaatcttaatttgaaaaaaaaagtttggtaatgggttcatttgcactgaaagagttttcttctttttatttgagaagacaacaaatacatgaaattagattaatgtctccaagacatcagatcatttcatttgtatatgttttggtatgttttactaaaagataaggactcatcctttttaaacacaattgcagtgccatcatcacaccttcaaaagtatccacaataataattttagaaatattttaaaatgatacaaataatgtttctggatgaaccttgagtgctgcccaccttacctctacttttcccctaggcaatctttagtattgcagatctaatagtatattattactaaaagtaagcatgctttctcttcttatttctagtggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttatactgagtctgatcgttgatgcctcactgctagggcccttagtctttctgcctttagatttgtaagtaaatatgtagcaaatatgtctggtgaatattgagttttttgttggattgacagttcctcacatgaccatgtggttattcaagtccaagattctgtaattgcccttggcttgttttcttctaggtatttctgtcctggcgattgtccttttgggtattctgtggttatcaaggagtgtgtctctgactccgtcagacagatctgtgtccaaaggaagctagtacttaggagaacaatcaaacaagaaaccagaaatctcggatgaaatgttggcgcagt

SEQ ID NO: 16669 - DNA, 1226 bp, Homo sapiens
cacaagtaaaatactacagaaattaatttctttcagcattgaagtgtttgctttcctctttatttcaactaagttgtaataatttctggtatcctggtaattgataactaagataatatctacagagtggatgccattaattctcttagcagtcacgtgcagaagggaagggtttgggccaacctagggttgtgctgtctctgtcgactagtctaggaaagcacccaggtgtcaggtattttggtcccttccaccacacctcagcaaatgtaaaacaagcccacagttaatggccctgtggcaaccctgccctggagaatctcaataagagcatttgaaatgaggaaagcaagatttcacatttaaatatcttgctttggcacacagttgcttttattgattaataagcaaataattataggggaactactattcatcgaatacacttattaaaatattatagcaccataaactatattggtataaaaatgttttattctttcttttgtagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttagggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtcc

SEQ ID NO: 16670 - DNA, 1206 bp, Homo sapiens
cagcaggggccaaggcggtgcggaccgaatgatctgagcctccccagccaggccccctcctactcaccctcgcctcctccaggactgacgtcccgggggcggctccaggaggcgcaacccggaccgggccgcccctcctgccgggccggtacactatatccagccaggtcagaccccacggcgctgaagctagccgagcccctcaaaaggccgcccgaggctttcggccgcacatccttctgggaattgtagttcccatcctctgaagcaccgcgtacacccgccctccgcccttctatcccacaggaccccgcgcgcagaggactcagtggaccggggccgagagcccaatgggaaaggaagttctagatgacggacgacgtgcggggtgaggctagtgcaggactacatttcccgaagtgcaccgaggtgggcaggacccggaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtgagtgagggaatgacagacccatcgacaaacgcacgaacggcctccggccctcgcccagggggaacactgctactcctgcccctgcttttccgtcttttcctgcagtgttttggagtgcaccctcccccgctgccctcactctcgcctgtcggcttccaggcgcggagtccccgaggcctgagaaaccagtgtcgggggagaatgggagaattagccctgagggactgatacgtagtcacggcgtaggagcttccccttctccccgaagtccgggggtttcggtttcgagggctagtggacctggtggtagcttgaatcggaaaagaccaagcatagacctagcgttccttcccaccctctccatttgggaagagtgtgaggtcgacaggtgctggggttgtgtgactctcactgggtctagatccctgaagcggtgcccgggttggcagatccctctgttgtggcttgatgcgattggttgggaacccggaactggagactgg

SEQ ID NO: 16671 - DNA, 1309 bp, Homo sapiens
ggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaagaagtttacgaaccttctttctttgcactgatatatgaaaataatgtttgggcgttcctattgatgtgtaggctggcttcccggactagcacacgatacatggtcataggcggttgtgcattgtgcatttcataggagctaaatatttacaaaatagagagtgatactgtggtaccttctgttatataccaagaaactggctaaatctttgtaattccatccaggcagacctccttctttgtgtttttgtgatcacaaaaacgatgaatgtaataattagtaaactaaaaaccaaggtaattaagtgaacacttcattgcctatctgtctatctcttaccgttagcacagaagtggcactgatctgaagaaaatgaaagcaacccccaaaatacctgtgagtaaaatatatcactgtttatgcctactgtcaatattctcacagcagctttccccttaaacaatgtgaaagagcccatcatcactggattttatttaaaccaggtgttcttagaatgctaggatgtgtgccgtttcattcttccctgccaacagaaatggcattttaagaagattgctcacttctgcaagttggtcagaaaatacaagtagaacgttgacgcctgagttagcaccttgctgcatgaacagtctggtctgtaaaccctacctgacagaatccttgatactgtaatacggctgttggtattcagcactgagaaagccattcagtgaagacgtggcggcaacttgtggccttgagaggctaacgtaggaactgtaaaatgtaaggaatcaccagaatgtatctatggtcttttggacaatttctaaatgaaaacagtgggcaatgattctgatctaaaatttaaacctgattaattttgaagtaatagtgggacgtgatatgtgtgtgtgtgtgtgtgtgtgtgtgtgtgtgtgtgtgtgataagtttgttgcattagatgccaggaaagtagtgagaggaaggctgctatgggacaggcttcctatctcatttaggttcatctcttgaaacaagaagccagtaccagctagctggcagaaatcccaacccagcagccgtagttttccttagattt

SEQ ID NO: 16672 - DNA, 1121 bp, Homo sapiens
attatgcaatgtttttattaagctgaaagtatttttctgtttctgatcctaacaaaagctaaataacatttaaaaagtacttattgaagcagtttccccaaggagtgtcagtttactagtgtagtgttagttagcatgtttacgtgaaattgatacatgtatataagtatacatctaaaatttgtatttttatttataggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtaagaaggatttcagttatgtccacacagttttgctgtattgaattataactgctaaccattgatgactgttggtgggaagacatgcagttgtctttcatagttttcatatagttactcatgatttgattttatttactgatgggaagagttatttgtatgttaatttatttatagcaaagcctttgagaaataaaacttgataatat

SEQ ID NO: 16673 - DNA, 1162 bp, Homo sapiens
gtcccttaatttgctctctgtcattcagtgttctttggcctcaatttcatagccctcaaataaatgattaagttcattccccaaaagccaattctatgtacaccatctgtctgtcacagaggtgaactttcttttagagcatttatttctttagcaaaggtgtttagttttctttgccagattgtttttaaacaacagtaactcctagcagtcacattctgcaaatatttttaaatgctttgaatctaaacagtttacctgctgtgtttatggcataataggaattagaagagaccctggatcttatctaaccccctatctgataaattttcttttcaaattgccagtaggtggttgacagtgggtgaattcatttgctgtttcagaacatttgaaaagtccttatttttcagcttgcgtttcattgttgaacgatctggtttatgttcttttaagatgctagtgatcaaagagaagatgtttatattggaaaccacatgccttgccctgaaaacctcaatggttactgcatccatggaaaatgtgaattcatctattctactcagaaggcttcttgtaggtaagtcagcgcttccagatcagtggtgagcattttttttcatcaatggttgttgctctatagaagggaatgaaatgtagactaaatattaccagaaagtagtgtttatttgcagtagacaagtaaaaaacaaatcagcagcatcatttggaaaaaaaaactggcaagtaatatgcagaaaacaaaaatcttttttttttttagggcttaacattttaaatataatactatacatttttaatacaaaaaataaatgtgccacattccaacactattttggtttttaggcaatctgtcacaaggtggctgagggactaaagactgtattaagaacagagaacatgtaactcaaataaaatatgtgctaaaatagatttctaaaaataaggggatggggacgaagaaccaggtgtgaattgagagatgaaaatggaaagggcgtaaatcctcaaatccctgattccagagaggttatgtaacttgttcaaggtcaacagcaagttagaaatagagctgggaaaaaactaagtctcagactttccgataccctacctgatgatcttagtgttttttgctgctctt

SEQ ID NO: 16674 - DNA, 1162 bp, Homo sapiens; identical to SEQ ID NO: 16673

SEQ ID NO: 16675 - DNA, 1831 bp, Homo sapiens
gtttcatgttatcagtcactgtgactagggagtttctaggctggaggaagggtgggatatctgtcagggatgcatacatagtagcatagacactggtaatgagttttgcttgtgccagtacctatattacatatctaatcctctcaacttccaggtttgtagaggaggtagcagtctgaattgtgttcatcttcatcttgtcttgcaacagataccatctcatttccctttcatgtaattgcttgcaatgtggctttatgtgcaaaatgtgtattactttggaaacatttgaaatatcctgaacaaaatcatcaaaacaatatttttctctctttctttttttaatgcaacagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactatatggcctctgttttggtgtgtttatttaccaaattttttgatattggtgtttcagtatatttaatatgtgaaattagtagaaaaagcagatttcggttcagaattcccctttactgttacaaatactgattgaaattatctaaaggcaaaagctttacccaacatttggagtttgcttttttgatcatttggcttctaggtttaatattagttacatggtggctttagtgaacttttttaaaaagctttactcttctacccacacagtcttatttgagtcccttagtcagtcagcaagcatgtttggaacagtccccggtgctttgcaagggttcagattgcagaacagtcacatatg

SEQ ID NO: 16676 - DNA, 1831 bp, Homo sapiens; identical to SEQ ID NO: 16675

SEQ ID NO: 16677 - DNA, 1177 bp, Homo sapiens
tgtccacatgtatggtgaagtcaccagatatattggcaggaactgggatagacagggacccaggtgctgaagtctttaatgaaggaaggatggtgcttacgagatagaagacagtgttgattggagtcgagggtgatctagctggatggtggccttaaagcagcattactttgtagatgtttatgtgactagaacagcgagatgggttgaggttctggtgtatttgtgtgtattattctttcctcacaccatcatatacctgttgtttatctcttctgcttctacttcttaattacttgtaagattttttaaaagtcaatagctttattcatagaaaataactaatgaataattgtgaccttgttgagtttaacggctcatttttcttatttctttgtggagactaatacgattggtttactgggcaggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcaggtagctaacttgtttatttgttcagatttttatttgaccaatttagttctccttactgttctcttcatttccaaagttgtgtcctttgtttcttcataattgtacctacccttctccagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggcaagtgttcgtgatggattctatcactgcatgctatctgggtttttaaagtagagctctgctttgaggctttccatttgagggaaaaaaaatggattttgttatttccagtttataattttggggggcttctttttttccccctgtgtcctcaggggaagggcaagagccagctttctctttccttgctactttggccagcagttccagtgaagagatggagtctcagctgcaggaacgtgtggagtcttcccgccgagccgtgtcccagattgtgactgtttatgataaattgcaagaaaaagtggagctct

SEQ ID NO: 16678 - DNA, 1190 bp, Homo sapiens
caacctaagttaaatcagttaaaagtgtttgagtaattaaatcagatagttgcttaggagaggcataactatttttgataccctgtcaatttttttctctgtcactgttattaaagagaacaagttagtgactggggtcctcaactatgtttttaaaataagcatcctgacaaatttcactcttctggtggctcatttgacacagaatataaaacacatatcaaaacaattctaggaggaaagaatacagtatatccaggtaccatctcctagttagtctaatttaattttggggtagattttacataactacagcaatgggtagataacttaataatctttataaaattgtctctcttgtgtaggacatcagtgagttcaaaattttacttcctgtctagcgtctggggcaatgctagattctgcttctgactttgctttgggccctcctaaggtggaattgcggagtgcagtggagcaagtcgttaaggaaactccagaatatcgctgcatgcagtcacagttctccgtcttgtataatgagagcctacagttgaaagcacacttggatgaggctcggaccctgcttcatggcaccagaggaacccaccagcaccaggttgagcttattgaggtaatagccttgccttgtcttttgtatgtaagctttcttgcctcctaaattttacaattttactccctcatgtgcaattaatctctcattcattcagctgtcattcatagagtggcagtaggtctttactctggtaggtactgggcatataaagatgagatgacaaaattcctgccctcacagatcttgtagtctgcagtaatgggagaatagtatccattagaatgcaatgtggtacaatggcagcatagccaaaagatgtgatacatgagaaaagagtgtctgatttgactgtggaagtttcctgattccacttaaaaaagtaaggtataaatattaaggataaattattggtagttgaaagtaggagaagaagaattcccggcatgagaacagcacatataaaggtatgagagagcatgagaaatagtttaatatggctagagcttacgtgtatgtgagaaaatagtgggtagaagctgcaaaattacttacatttcttaaacaaaaagcatataatggcaccagtagatgatttttttaaaagatagaaact

SEQ ID NO: 16679 - DNA, 1187 bp, Homo sapiens
attaaagaggttgccaatgtgtgacagaagtagagttagtaaactaacacattttgtacactttgttaaaattcatagaaaggctgtcttctgaaaaggacttttgaaagtgaaatgataacatcagctctaagtgacacatatacctatatccaccaggttggtggtggagaggagttggaaggaatgaaggattctagaccagaatgctcctatttagaagacactttcagatgtaaccactgttacatgtgtgtagtttattcaacactactgtgtccatagtggacaaacttaagtccttatttgaaacataagtctttctagatgtttagagatgcccaaaatatgttaaaagcagaggcagtaaatatagtagaggtagaaacatagtctttctagatgtttagaagtgcacaaagtctgttaaaagtagaggtagtaaataacacattttgtagctatccttttgatatgaaatattgtcttatggaaattgatcagttctctaagcagtacacattattatatttgtgctggttcataggaaaggaggagcacaaagtgcaaagggctttctaccagtgtgtttatgatgatgcccattgaccattgtcccttatgtctgcattttcatttactgtgctgtgtatatagtgtatataagtggacaaaagagtcctaatttacatctagtcgatgttaaagggttgccagtgtatgacaaaagtagagttagtaaactaatacattgagtacactttgtgttaaaattcatagggaagacgtcttaaaaacacagaagtgaaattgttaaaatcccccttaagcattacagatggcttaaagctgtctctggggttggtagaggtcggaaagggaagggttctgggccagaatgttcctatttagaagacactcaaattagagtctgtgttatgtatatgcaccatttattcagtgctattgtgtatataaaggaaaactttagtccaatttgaaacatctagtctttttaggtgtttgaaagtgcacaacatagattaaaagtaaagggctaaagtaacacccctctcagtatttgttttcattacttcctaggagtggttgcatttgggaatggaatttttaaacttgatgcttaggagcatatgctgactattcattgggtggcgatgggttaggga

SEQ ID NO: 16680 - DNA, 1121 bp, Homo sapiens
aagctgcttttctttcattggtatttttcctttaaacatttgttgaaatgttttaaatgttggcagggaaattcttgtgaaatttaatggctaatgatgccactaatcttaaaatgagggaaatttaatctcagttcaaaatgtcttcagagttactgtatcattaatgttaaatatccacatttacatcttataatttgttttgctatgtgggttttttatggaatatttacagtaatcatatgtattatagggattagaacatcagagttgttcttactacattgaaacatactgaaagatctattgtgatttaaaaacaacagctggctagtcatttgggacattttaaaatttttggtttgttaaaaccattttgctgattctactttcatttcactttaatgtgttgtccaaaagagctcctgatgagtaaagtataactttttctactttattatctaagattaatttttgtcaacttttgtatttcagggatccagagaagaactggaatagaaattgtgtgaaaggacttgtggcttctctgattagtgtgaaagacacttctgcaaccacagctttagaattagtggctggagaacgactctacaatgttgtagtagacacagaagtaagttgattttaattttaaaaaatttaaaatttggttagcttgaaaagtcatgtgctgctaaaagaattaaatactttgatgttttaaggctctcccctaaggtgacttatttatagggtaaaactatttggttcataactttttgataactattccaaaggaggtctcatgcttactcagaaactcagaatgcatattaccaatcttaaacttttgggatctctttgctgtataagttgaatttaatttgtaaaataatctgggaataaatgacctgtttttgatgtcagtcttcccatcaaggtaacattgaatttatttacatttcttcagttctcacttattatccttctgtagaatgctcatattctttcctgtaaatgctacgtagtcattgtcaaatttacttccttgttttttttttaatttattttatatatatatttaaaatgtacaagaagcctgggtatggtggctcacacct

SEQ ID NO: 16681 - DNA, 1918 bp, Homo sapiens
gagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgag

SEQ ID NO: 16682 - DNA, 1166 bp, Homo sapiens
tgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcac

SEQ ID NO: 16683 - DNA, 2143 bp, Homo sapiens
ttttttcaagtattcttccctccttcacacacagttttctagttaatccatttatgtaattctgtatgctcctacttgacctaatttcaacatctggaaaaatagaactagaataaagaatgagcaagttgagtggtatttataaaggtccatcttaatcttttaacaggtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaac

SEQ ID NO: 16684 - DNA, 3005 bp, Homo sapiens
aatcctagacactgtaggaacatgggccagagaagtatgctctgtgtatctcagagatgatcctggataaagtgtgactttcaacattcataagaatttcagctccaggaattcaggggagaaggattctcagtccattttgctgtcttgctgtttgtgaccatgtgtatatttgtaacatcattcatgatctccttttaatggtaattgtctaagattatactctgtatgactttgttttctaggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgggaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaacattgtgtttagaaattataatctatgtgtaaccatgtcatttgagttgcaaattaattgccaggctgttttccttaagtaaattcatgtgccgtgtagaaatatgcagatatgcattacacaggcacacacagagagatatttaatatgtggaatatcactctttcatgagctttattccttgattaatttgataaagcctcacagaggattttaagcaatatttaaatgtgttgaggttatgtttggatattcctgctgcctcttttcattcatttcaagtcattcttcagctagctatgggctgccttattgctattcgctcactgcttccatcttctgcccaagtgagaagaatagatgaagaacagaaatttctctgtgaaatgtg

SEQ ID NO: 16685 - DNA, 1211 bp, Homo sapiens
gaggagtatacatgattcttgtgttcatgttgtcatttgaaactcttcacataaaattttctaatattcatttggaaaacctctccactggagaggtttcatctctgagaggttttgtaataatagtgtaagttcagtaaatccagtccaaattctcatcacatgtattatttgatactaaattttcaattattacttcaaaataagagtctgaggatttcttcttactggcgttcttaaaggtctctaaaattaaagaacaagatgtggttttttgtttaagacgtttttagtttatttgttgttaagttaaactggagaaagtttgtcatcctcattttcaaactgaaaactaatcaaatatagtgcctatttagtctcaaaataaggtaactattaacttgattatactatataatattctcaattacatttgaatttaaaaatattgagctcttgattacaatttaatacattgtaaaaagtattaaatcctttgaaacatcttttgttgcttatttagtttttgtttctacaggtcaaacatgattgctttctataaaagaaatgcttgagaggttgactataatggatatgtcacaggtataaaacagttgttttctaaaaacatgcatttagtatggcattctcttttagcaactgaattcccaacgagttttattaagctggatatcgaaatgaaggagctgccttaagcactttagaaaaagaatttttttacaattcattttgactctcatggctgaccatgtcattatgtctttaaattttggtaaatatgtagataccaagcattaataactaatgcacacagaaatttaatatacagcaattctttgaatgttccaggtgtacgtaaactaactgaaagtattaaggacatgcctgtctatacatgggtttcattgatggtatctgtatcatcttgacaaatcgtgaactgctgctgtatggctagactttgcctatttactctgttatgcaaacagtaatttttccctatgttatgaagagagacatattggcttgctttaatttacttatttatgaaattaaagcatgaataatatgtataatttgaattttttgtgactgatccttggcagtataaatgataaaagtaaatgtaatggaatcttttaattaggctaagatatgctatttcataacttatgtagaatgatttttat

SEQ ID NO: 16686 - DNA, 1161 bp, Homo sapiens
aatcttggctcactgcagccttgatctctcaggttcaagtgatcctcctggctcagacccccaagtagctgggactacaggtacatgccaccacaccttggcaaatttttgtttgtattttttgtagagacaggttgcccaggctggtctcaaactcctgagctcaagtgatccacctgcctcagcctcccaaagcgctgggattacaggggtgagctatggtgcccaacctataaagagagtctttggctatatctttcctgctacatactttgtatttttgctgctttcctttattctcccaccactaccttctgcccatcaccctcattaaaaaatgttcttacagagcagattagcacaaaaatatggctcaagttcaatataagaatcactttagttttgctactagtatttggctttaaatattcaatgtttaagtgttgtttcttgatgtttgatgcttctttggttctaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggtaagttcagagtcaaaacgtgaaatgtgaaatgagtgttgttcagtcataattcttgcagtgtttttacatttgagtattgaaatctaatatataatttatataagtatttacagtaacattattcttaatgactccaaattagaagccacccaaatgtccttcaacaataaaaggattggctgggcactgtggctcatgcatgtaatcccagcactttgggaggccgaggtgggcagatcacctgaggtcaggagttcgagaccagcctggccaacatggtgaaacctcgtctctacaaaaaaatacaaaaattatccatgcattgtggtgggtgcctgtaatcccagctactggggaggctgaggaaggagaattgcttgagccctggaggtggaggttgta

SEQ ID NO: 16687 - DNA, 1216 bp, Homo sapiens
ttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgagatatcttgtatttatttttgagacttgcagtagaaataacagacactaacattcacagacaatctgataaaatagtaatcttgccaccagtacagtatttctaaaattcaactatggggaccctagtagtctgcacacatatacctgggtatccaaaagttctcagagataaaacctgccagccaaagaccaccaggaacacacctgtaatcaaacaaagttaggtttattagcttgttgtagtaagaggaaacagccaccatggggaatcataacatatttcagggagaaggaactagaaaggtcttttataggctttgagctgatgtcaaaattgttaaaagtaactgtggtggagtggaaataa

SEQ ID NO: 16688 - DNA, 1113 bp, Homo sapiens
aaaatgagtccaaggcagaaccaaagccaacattaagttaccaagaaatttggattcagtggagaagctcagaaacttctaaaacttttgaagtattaagcgtttccttgacaaatggcattggaagacatatcatgctagaaaatgtttatctggtatttttccttctttgaagttatgaggtcaaggacatcatctccattatgtctgattgcctctctttagccaatgttccaactggcaaagtccaataagagaaatctactgatactggaattttttcccattaatggatatatagccccatcagctcgaggtatgtgattagtgcattccttaagatgttttgttctgacttctgccacaggttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtaaatctatactaaacttggcacggccgatgtattttaattgctcttgtttccttttagcctgtagccatggttcttaatatacgtggcttttgcagagtttcttgtgctttgctagccatttttgtggtttgggcatcatgtatctctccttgagtaccttaggttttatcctttcgaaagcttcctcatatatcctacctttcaatttggagaacaagatagttgcttggaaagttctagaaaaagtagtacaatttatgcaacttgtatttttatagctgtgtggctcatttatggagatgaggagaatacctaaagctatacactgcatctttatccatgagaaggtgcagtacgtatatcttcattgatgctttgtgaatactcttcaaggcctcatcttgagacttcaggccttttgcatgtgatgtttagtaatgaagaataattggaatggtactgatttgcatgattggatattttaattatcttt

SEQ ID NO: 16689 - DNA, 1793 bp, Homo sapiens
tctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatgggtaagagataccagtgagccccagaaagagcccaacttcagaaacatcacccacgattacaatgccaccaatggggctgagattgagctcaccctttctgaagatgaagaggattattatggctcctcaacaaacttgaaagatcaccaagtttccaatactgctctgctgaatacccaaactcccatctatgggactgagcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaat

SEQ ID NO: 16690 - DNA, 1124 bp, Homo sapiens
atacccctccatttataatatagaacttgatatagtcctcccaaaagagaagtctgtgatattgtgaattaatagaaaaatgttgcaaggagcttggcaatttccttttgtaccgatttttaaataaatttcaattggtttttctgctctaaactctagaataatatttgacaaacactatttttatcaagacatttctcatcaaggaaccacatgtacttattgtctgtcatatcaaagtcttcagcattgcatccaaagttcaccatttagtcatgctttctccattgcacagtggcttcactagcaaatactgacattcctaccatctctctacttactaccctaagcatttaatgtcttcctttgtacttctactcactttcagtaagctctgctgggaggttaggtggatttctttcctgtctgcttctctctactagtccatgactttcacttcctttaaggattgattttcactggccccaaactactcttattactcttcctggtgctgtattagtacttgcagatatgctatttttttctgtcccctaattttccaatatggacagttaggtaagtacttattaaatacttattcttttcatggaccagtggtatcttggaggcatcagttttcagttctgttaattgtactgggtcctcaaatacattttaactccactaaccaaattacacaggctgagtttatttcatttccatttaagaggcagatcaaaagacaatctgaagatgaaaccttagggaatgctctaacattaattctctgacacaattactctgccaagataaaaaaatcttccttgacaaagagcgttttaaatattgtcattgttccctgcatgatgagacctcctgtataggtgggaagctgaaggttgagacagggtataaacccttctgtccctcagaatgatatagaaagtatgatggagctggagaaatgaacatttctagtatggtcagctgttagcagagttgcttcttggagcaagtgcgcacaattattgatcttagagtgggctaatttgttctctgtgtctctgtcaatatacagtgtttggttgcagttaaattcagattcaaagatgatatagcga

SEQ ID NO: 16691 - DNA, 2959 bp, Homo sapiens
tgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtgattgtggagttttgtttgccacatgtttattttctatcaatttgagtgttacaaacacagcacaattcagtttttcatatgaattgtttttcgtgtgtgtgttgttattgttgttttaatttcggggcaagggagatttagttttttgtgaataggaatgtttttattttaaacatggaaataacaaagaagttaactttcttttttttttttttttttttttttaatttaactaaagaaccaaactttcggcacagctatgcagcttgtgggccagacgaggaggtcctcctcacccttttgttgcctgtcaaattcacgcattatccgtctcataaataatttctgttaggattggctggcttttgtgtgtgattttaaaatctgtgttttgtttctgctggcattgtgttttgttgggggttttcatttatttaggggacgaggggatgtactagaatcccatccctttcgtgagagtggacaagaaataacatatcctacaaggagcctggagaactactttctttctttctttttttttttttttttttttttttaaatctagctgccagctgctctgtcccccatatcagctttttcaggagggagcagcttagactaaatctaagcctacatttataatatgttctgattgtgaacaaagggtttcgttccaaaaaatagaaaagaacttttcttgaagcctaggttttagaagcccgtgtgtgtgtgtgcttggatgtgtgtgtgcgtgtatgagtgtgtgtgtgcatgtgtgcacgtgtgaatcctttggttttcatgtttttttttttttttttttacttggaagggttgtgggagggtgggagggaagaaagggaaggggaattgctgagatgacagtgtcccacacagcttcaaataaaatccatggaaagatgttgcatttgtggaataagtgcttacttgaaaagcatgttcttcttttattttcttactgttaagaatttttatttgtaggatgtttgttttaatttaatttttttaagggatgggggccatcatgtggaaaccagaaaatggggaaagtgtgaactatccagacaaagattcattttgtgtctatatttgtttttaattggcctcatttcaaatgtattaaacagttccatacctggattgggtgtttgtaatggttaccaaaaaacaaacaaaaaaagaaagaaaaaggaaaaaaaaaaagaaaataattgtgacatgcttttatcactactttatttttcaaataacatgtaaatattgtaatccattggattttgttttgctaacctgttaataaaaatatgggaccattatccttttaacaaggctagaatgtcatttttttctttttcaaacatatacctgatattttgtggccgcacattttggatgcattattataattctgttgactgtaatgacatagaatttacaacattttttgttgttgtttaatttatacagaggacatttttttcagagcttgagagaagaaaataaatagcaaaatgataacctattgactccagtaatcagtgtttcccaatacttcataagagatagggagaccctgagtccttgaagccaagggtttaaaaacaaaacaaaaacaaaaaaaaccacaagtaggttattcaagttgtttgcaacatacattttgtaatgaaatgtgagaaattaataaagaatttttttcacatgtgtctatgtgcatctgttgtaaatcatttacagatatgactacagatatgaaatctagaaatattatagcactacctttcaatgcttgtacacgagatattttaagtcattgaatctacacaggtatggaaagcaaaggtaaagctgaggtgaggttgaggttgagctgggattttcaaatgttaatatttctgcatcaggtattcatcaccaactgagggagttttagggaaggaatattttccatcaaaaatgtgaatcaaagtgatgtgtgaacttcagaaggaggaagcacccgtgattaaacatcatctgggaccctgaatccacaagcacagtcattttaagctaactgccaagtcacacccactgcacaggatctatttcaatgttgccgtccttgctta

SEQ ID NO: 16692 - DNA, 1168 bp, Homo sapiens
tacaacttaggtacataaagtttttttgggaaaatgatacggtttatatctatatatatatatatatatatctatatatctatatatatttcaaattttttattttatattaacttgatatgaagatggaaattgttgggtaaaattaattgtggttgatagttaagattaacatacgctgtcatgagctttgaaagagtaaccatgagtcagattgttaatattgatcatttattgtgtcattttacaaaattattttcaagttataggttgttattagtgctatgtttgtggcatcctgtaacggtacagtctaattagagatcaggcagtatgtagtattttattgtaattattttgtcttttaatgtgtttagcccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacaggtaggaactggattctaggacattctatctcaaaatccgtgtttaacaggaacttcatgcatttattttgattattgttttgatcaaaccgactatatctattacgttaagctttttttaaatgtttgactaaaacatatgctgcgtctgttttgatagcttactaaggagaatataagtacaaattttcataatcagatttctgtactctgttgatttgggcagggtggggggcagtggaaaggagaaagcaggtgaaagtcatttttttttttttgagtagaaacgttaggaaatacaaataaccaaaatgaataaggattacatcatgacattgccaccctgatcatcatttgtacttgatctgtattctttgtggtcattgtcatatatatcataagcatccttccatgttagtaaatctttcccgtagttatatagcattgtgtttggttctgacatttgttagctcttgtaacctgaacctatggactatttcagtttttcactgttgtatctgta

SEQ ID NO: 16693 - DNA, 2167 bp, Homo sapiens
tatatttttttcctttttcttccagttaaaggcattaggatttcctgaaggacttgtgatacaagcgtattttgcttgtgagaagaatgagaatttggctgccaattttcttctacagcagaactttgatgaagattgaaagggacttttttatatctcacacttcacaccagtgcattacactaacttgttcactggattgtctgggatgacttgggctcatatccacaatacttggtataaggtagtagattgttgggggtggggagggagggatctaggatacagggcagggataaatacagtgcatgtctgcttcaattagcagatgccgcaactccacacagtgtgtaaaatatatacaaccaaaaatcagcttttgcaggtctttatttcttctgtaaaacagtaggtaacttttcctaggtttcactctttttagtgtactagatccagaaacttagtgtaatgccctgctttatatttctttgacttaacattggtttcagaaagaatcttagctacctagaatttacagtctctgtttcatggcaacactggataatggctttgtgaaatttaaaaaatttttgtagcgactgtaaacagaaatgccaaattgatggttaattgttgctgcttcaaaaataagtataaaattaatatgtaaggaagcccattctttcatgttaaatacttggggtgggaggggagaaagggaaccttttcttaaaatgaaaataattactgctattttaaaatttcttgatcattgaatgtgagacccttctaacatgatttgagaagctgtacaagtataggcagagttattttcctgtttacattttttttttgttttggggaaaaaattggtaggtgtctaattactgtttacttcattgttatattgcagtaaaagttttaaaacaaccattgcatgtttgcttttgatgtatccctttgtgaaattagcacttttggggccaatggagaaatgcagcattcactctccctgtcttttccccttccctcagcagaaacgtgtttatcagcaagtcgtgagtcaaactgctgccttttaaaaaacccacaaaatgctgattcagttcaaaattaatgcaaatgtttcaaaactgggtttctgatatttgtaaatgtgtttctttattagataagagtgtattaccattaaagtcattagtataatattgctttcaaaaagaaatggtagacaaaactataatccagcatcttttattgcattggaaagactggcaaagtcttttggatgggttgggagatgtggctggaaagtactttggaaaatatacaatcaagatatctcatggcatattaaaagaaaaatcttaatagcagtgttggcttttatttggattttttcatctcagttttttctgtggaatctccttcattggcattgttatttaatcataaacggggcagatgtctacttgttcagtttttcaaatctgttttcctgagtataaataagagtatttaaagaaataatttggattgcttttgttttttgtttccttttttttaaccatctgatactaagaagatgaatttgcacagatttctctgcataatttctcaatatctttagcacagtatggtgatgatgacttttaagcatttacatcacgtactcataacctattatgaaaataaatgaaactggctgggtatggtggctcatgcctataatcccagcactttgggaggccgaggtgggcagatcacttgaggccaggagattgagaccagcctgaccgtcatggcgaaaccccgtctatactaaaaatacaaaaaatagccaggcatggtggcgcacgcctgtggtcccagctacttgggaggctgaggcatgagaattgcttgaacccgggaagtgaaggttgccgtgagctgagatcacaccactgccataaacatgacaggcttttggactttgtattacctgtatgttttataatggatcatgcataatttctcaggagaataaaatgagaattcatatatacgttcatctttcaagtcagagcaatgagttgggaaaagaggtggcatttctgatcggataatggaatactctcatttattttatgacattctctgtctactcagatcatagtgaaaactg

SEQ ID NO: 16694 - DNA, 1197 bp, Homo sapiens
tttcatatttgaaaaaaatctttatggtttgtcttttaaagtaaataaaaataaaaaagttttctgtggaggcctgtcccagcacccctcacatctgagtaacaaaagaaccttcctacagcagacaaccctaagaacgtagttccacagtgccctcctgaggattaaagggttcatttatgcttggtgtgtgttaaagatacatcacttctactagttacagccttaaagaggtcagaaccaaagtttctggcagattgttttaaagctaaatcagttcccctgactgaaggtgggaaaacaaactgaaataaaataatttaaaaattattcaaattcataaaactaagtgtaaagtaagatggtgttatggtaagtttgtagcgtttatattagaagttttaatattaaaactcaaaactgccctgttagaatctgaagttcttgagatgggtgcctgaaagattgaaattcatttggggctatcgcaaaatggaaaaagcatttgtgacacttgttgacaccttatatacttgtaatagtgatgtgggtgactaaacatcatcaaggggacagagctcactgctcactggcattttttttagagtgcttattaactattgattgtatctagtgtccagaggtgcgtttgtaccatgggtacatgtaataaatgaaataaaaaatggatgtttataagaggcttatggtagatcagcacaaggtattttctttggcttttgagagtccaccatgactggaaagcatagcatgtgtctctgcttaaaagaaaacaggtgcatcaataggatggaattttatgtggccaagaacatattcaaagcatatttaatgacatggaaaaatgctcatagtaatgttaagtggaaaaagcaggatataagactatcaacagtaccaattcaactgtgtacatttaagtgtatgtgtgctttgaaggagagagagagaaacaaaaggaaattaagagaaaaccctagaaggaactgccaaaatattcatactggttttctcagttttaattttcttttctttttttttgagatggattcttgcttgtcaccaaggctggagtgcagtggtgtgatctcggctcactgcaatctccacttcacaggttcaaacgattctcctgcctcagcctcctgagtagctgggattacaggcgcccaccac

SEQ ID NO: 16695 - DNA, 1905 bp, Homo sapiens
attgctgggaagattctgatttagggttgtcactgcagagcatttccatgtcaatgtaagtaggtacccaaagtcgtttaggtgcagcattcagtaacgtaaaggtaaagaaaaaaaaagtagccacctgtggctttttatccccagtcgtagtaggaataagattgcatggtttgggcacactaccaatcacaatttccaaatttcatttccaccactgagatgccttgactcaaatgaaacattagtataggtttaggtggtgtttgtgtgtttttggtgaaacattagtataggtgtaggtggtggttgtgtgcttaactgaccccctaaaaacaagaccaaatacttaagcacggaatgtatttctgtttatgatatggaattcaatacaccccttcagtggtataaagacattcctggatttctttaggatagggtcagagttggtttactatctggccttcagtttttaaaaggggcgattctttgatatagcaatagcgtcaattttttttttcttttacctttacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaataatgttttttattgttttgttttcctcctggaaaaatatgaacagtgtttggtttaaacacaccgggttaataaggcatgtaagaagcacgcacaaaaaagccaactttatgtcaacaaattaaaatacctttttttattaaaaaaaaactatttagttttaccataaatactatcaatatagggctgagaactcttgattattgtacgtttaaaaattacaagattaaaaacccagttcaggtttgctctttccaaatgtacgtaaagctacgtgaaagcagtttccttacct

SEQ ID NO: 16696 - DNA, 1157 bp, Homo sapiens
ttacttccaaatgctagttccagctaaaaacaagtactttttattagtttcttgtctttcaacattctgccatcaaaatatattcattttattaacttaccgattattgggaacctgcaaaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactcc

SEQ ID NO: 16697 - DNA, 1133 bp, Homo sapiens
gccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaag

SEQ ID NO: 16698 - DNA, 1197 bp, Homo sapiens
acttggagagaagccagatggaggaagagtgcttgaacatactgctctggaagggaatgaccttgaagcagggtccttcaactcaggattttttctgtttatttttattatgctgaggtttagaaactaatttctgattgggctttggactcagtacaagttttgacacatgttctgtaggtgtatttataggaccgtatattaactattgattgatagtagcaactacagaacccttgaattttattgcttaagaagagatccataaataagacacacacttagaaagatttttagtatcacattttaagatattgagcctttacttagctagaaaattcagttagatagggcatatcatttccctaatatttgagtttgtgagtatttaacttgttttgttggaagttgttgaggaggagctactgcttagattcttttgctttgttagtgttttgctgatgatgttaagttgtttttcttttactcttttttcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcagggtaagtaagccacagaatttcttattagtgaatcatccaggcatttccgtttttttttttttaaaggaggatttttttctcctgggggtatacaaaagaactggtagtaggaattttcagtgaaatagccttttgtgttcccacaaatgaaattttcattgaaaatagtattgtttacaaggcatgatattttggggtttttttttttttttttggttgttgttgccccagagttccagagcaacttttttttttttttttttttgagacaatatctctttcactcagactgctagagtgcagggtgcagtcatggctcatggcagccttgaaccttgaactcctaggctcaagcagtcctcctgccttgaacttcccaaggcactaggattacgggaatgaaccaccatgcccagccaatattttcttattacatatgtaatatttataatatatatgatgtcctgggttaaaaccaaattgtgaataattttctcttgatttagtgacatttaacctagaaa

SEQ ID NO: 16699 - DNA, 1152 bp, Homo sapiens
gattacaggtgtgagccactgcgcccagccaacttgtaaacatttttgcattatacactgaggaggagacattgatggttttgctgtgctcttttgggccattctctttcttgggagagaaagttcacgcccggtggtattttcaagaaaccaaggcagactttatggctttgagatctatgcctaattctggtcattctggggtgaagtagatggtttgagttcgggatggttttagacctttggtatacgttacaatagactctctttaatagaaccccattaaaggtaggcaggcatgtaccctatccatttgaccaggggcctctgagagcagggatgaacttaattttgagaaatcttgaagtttatctaatggacttaaatttttttttttttgcctgataagtaattctgtaactaatatatataccagattgttctgtcaaactacaaaactgagttttgtaaaaacaagtactaggtttttatttcactaaaaatgttaattcttaataatttgcagcatccctggctggctcatggagaattccagtattcctggttattgttttcctgatgtctgtgggtaccctctatgaaaaacagaatggaaaagagtcttctggtaagaaatagggcattctattaatactactctttgaagtattttggagagtagctttttaaaaaatgctatgatgaaacagctttgaatctatttaaaaacctatgatggtttctgagtggaaaataaattgtttaaaatattttaggttgttagaccatgatttgttttggtattattttattgaggcatgtataacttaaagttaaccataagccattgtattttaattttattaaaatattttatttttataaaataaaatatttttattttattttttagtgacaaggtcttgctctgtttccaggctggagtgcagtggcacaatcatagctcactgtaaccttgaactcctgggctcaggggttttccaaccttatcctcccaagtagcgagggctacaggtgcagtaatcacgtaaaaatggcctacaggccgtgcgcagtggctcacgtctgtaatcccagcactttgggaggctgaggcaagcggatcacgaggtcaggagttcgagaccagcc

SEQ ID NO: 16700 - DNA, 1143 bp, Homo sapiens
gcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtgggtgagtgagcggcagtccgcccccgtcccccgcccgtggtcccggcgctctggggtgcaatcctgcagctgttcctcccggtgcaggggcgacgaggggccacacctgtgctgcagtgaccgtccgtctccgctttccttctcacacctcaggaatttggcggacattcttccaaaaagggggcgggcgtgatttgaaacagcctccctgcttttcgccttgtttcaatcctaataggccctcttagggggacagtgccctggattgagaatcgttatttcgctttgcagagagaggcctcagagcatggcagtggggcttggttttacttctggttggagagggcgggggtgcttcggccaccctcagttctgcgcatctgaatgtcagagctggaagggaccttagagattctaggccaacttgccatcctgcagataggaaaggtgacctcttaccaggctagggctacttagggacaaagaggggtttgggtgtcttagatttcttacaagtcctaaaacaaagcttgcttcactggctggtgctgcctctcagttcaggtgattcctgtataatttgtgcaaggca

SEQ ID NO: 16701 - DNA, 1193 bp, Homo sapiens
gtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatc

SEQ ID NO: 16702 - DNA, 1210 bp, Homo sapiens
cgaattctgtatttttagcagagatggggtttcaccatgttagtcaggctggtctcgaactcctgacctcaagtgatccaccaaccttggcctcccaaagtgctgggataacaggcgtgagtcactgcgcccagcctgttctgtggtctttctagtcaattaacagtaaggtcttgggaatctttttgtattactataatttggcatccctcattgctttaattgctgcataacgttccatagtaaggccgtgcccttcagaatcctgtgggcttacgagtcgcagtttacatgtatttccattggtttttctaaggggaaagagccctgcccaggcggaactctcctatctgaataaagcgaagtggctggaaatgtatggggtagacatgcacgttgtcagggtaagaactgtgtgcgtttaagtaatttggttttgctgttactgaaaaatgtatgaacattatgcaaacaaaataacttgtggtgaggaaactgtttttgcattttgcattctgctgtgtgacgacctgttagaaccctctaccgattgtcacttcgtttgtttgtagggaagagatggctgtgaatattctcttggactgaccccgacaggcatattaatctttgaaggagctaacaaaataggcttattcttttggtaatttagttttgtctaatattaaaaatgtcttttcctattttgtggtggaattctatgtgatggatgattattgaggggtatctgcaacacccagattcatcctcagagcacacggtgctgctgttgtgggtctgtggcagttgcgctgaaacttctggataatcacacttggatgaatgtttttattttttttttagtctaagctttaaaagtagaaaggaaactgctatttgatgtgtagatagttttactgcagattgtgcttttaaaatgctttctgtctgactaggcctaaaattaccaaaatggattttaaaaagagcaaattgacactcgtggtggtcgaggatgatgatcaggtaggcctggctcccatttcttcccccttgctgtgaaaatcctgtgttggggttgcaaacgcccactcgaggcccttgtgcttcctctttaagggacgtgagcaagagcacacgtttgtgttccggttagacagtgccaggacctgcaaacacctttggaagtgtgcagttgagcaccacgcattct

SEQ ID NO: 16703 - DNA, 1738 bp, Homo sapiens
gtgttgagtccaggagcaggctccctgaccccgtttctcaaaatgggctcttactgaggcttccacacttccacttacaagaagggctgtcccgcagggacttttgctccttcccacctcccccagaccgccagtttctccctctgtcatgtctccatgacactttgcccacccctctctgggagtgccccctccccgcatcatataggaactagggcttcacaggtgtacctggcctgtggcccagagttggcgctcagggaatatttacaaatgctgcaaaagacccaccggtacagggtgtggtaggcagcatttcctggagctacaggacttgacagcatttttttcttttccagagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaat

SEQ ID NO: 16704 - DNA, 1113 bp, Homo sapiens
ctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactg

SEQ ID NO: 16705 - DNA, 1113 bp, Homo sapiens; identical to SEQ ID NO: 16704

SEQ ID NO: 16706 - DNA, 1514 bp, Homo sapiens
ggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaataatggctgcttgtttgaccgtgagggaggttggaagactgggccaaacagtggcacgccagcgtcctacttggccgctactgtgtgacagcttctggttcctcatgtttgcaacaaaggaatcaatccgagctgagggggcactgctgcaccaggctgttcccacagcccccttttcaatgctgtccccagccaccctggctagatgccagaagctgcaagtgcctc

SEQ ID NO: 16707 - DNA, 1514 bp, Homo sapiens; identical to SEQ ID NO: 16706

SEQ ID NO: 16708 - DNA, 1200 bp, Homo sapiens
tgggcaataggaaacccagtataagtgaataaatcactggagtgatgttccctttaaagattgaggcatatcaccaagttctgcttttaagaatttttaaatatgccaaaattcattggcttaagtacataatgtgacagctaactgaaaatcaatctttcctagaactagtcctatttatatcataaagcacatagaatttcttagacttgggcagttcatttgttgttaagtattgtgtaaaagaaaatttgtacttgagccttttgacttttctcttgatattttttctttgtttataacttaaatgaactgtatgttattcagggaagtttactttaaataagattatacttctttttccctccacccctattcttccttcattctatgctgaatacatatttatacatatgtatatatatacatatgtatatgtatatatataaatacatatttatacatattttatgtataaaacagtgctacagtgctacgtctaatgtcaattcaatattctcttaacaggtgggtgaattttctggagccaataaggaaaagcttgaagccaccattaatgaattagtctaatcatgttttctgaaaatataaccagccattggctatttaaaacttgtaatttttttaatttacaaaaatataaaatatgaagacataaacccagttgccatctgcgtgacaataaaacattaatgctaacactttttaaaaccgtctcatgtctgaatagctttcaaaataaatgtgaaatggtcatttaatgtattttcctatattctcaatcactttttagtaaccttgtaggccactgattattttaagattttaaaaattattattgctaccttaatgtattgctacaaaaatctcttgttgggggcaatgcaggtaataaagtagtatgttgttatttgttatcttttgacagagaaaatagcattctctgttttagcaggtgaatcctctatgctctccaaaagatcagcatgaccaaaattgatgtccactcatgaaggacttgttcgttttgtttgtttgttttgccacgaggatcggatcttgattctcctcgaagtatctgagaaagtctagttgtataggccagacataggttctgtcttgagtggtaaaagttgtgggaaattattacttatatcattcaaagaacattgtttcttg

SEQ ID NO: 16709 - DNA, 1622 bp, Homo sapiens
ctgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacgtactttatacaaaatacagaatactttatattggaagtgaaagaaatgaacgtggacttttacacatgtgcatatttttctggaggctatatggattatttgaaatgaaaagcatactaattggactttaataaatcattttcaatcagcgtttggtaatgtgtggttctggtcagtgctatttctcttgttcgagagtcttccagcttgcattgcgtgggtgtttttcccactatgacctcctttatttctctgtaacaagggctgcttaaccctgaggcggagcaaccgtgtgctcccccagcccacaactgctttttttcaatctgagtaataaatcttgccaatgtctgggaggtggtagtttatgttccttgagaggagacaatttattaagatggtactttagctcaacaggataaccgttagagtgggtttctttttgaaagactgattttacaaaaaattttgacaactttatgaaacactctcactagtttataaagtcacggtggtatttctacttataggtttaataaccaacaagataaaagttatatatatatcttccaatgatataaccattataacattttcagtatatcactaaggtgttggaaaaagataaaatatttattcaagtgaatgt

SEQ ID NO: 16710 - DNA, 1126 bp, Homo sapiens
cgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgta

SEQ ID NO: 16711 - DNA, 1138 bp, Homo sapiens
gccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggtaagttctgtcttgactgtaacttactttatagattctcagtgactaacataaaccacattattttatgtcagaggtaaccaacagtatgaatattcaccaggtaattcaccaggaattacaaggggatgaggcacctttatattaaatgtcagcttatgagtcttcctaaaattatagaattagcgttagggaaacatgggtcccagtggtgcagtataaatgatgatgatgtaaaagatgtcattgaagagtttggctatctaatattgaaaataccagaattaccagtcaaactcattcatttttcttacagcctaaattgtgaaacttttgcattgtggtttctgtattacatattttcagacagaaagtgcttttgtagaatatgaatatgcttccatatatagttatttttgttagtctattctgtaa

SEQ ID NO: 16712 - DNA, 1243 bp, Homo sapiens
gtgctaccacatttaattcagtggaaattatgtgaaatgtctttttcatctgttaatttgttcattctgaattcattttataaaatttgcagcctgttggaaagggctgttttttgttgttgttgttgtagtcttgctctgttgcccaggctggagtgcagtggcacgatgtcagctcactgcaacctctgcctccctggttcaggtgactctcccgcctcagcctcccgagtagctgggactacaggcgcgtgccaccatgcccggctaattttttgtatttttagtagagatggcgtttcaccatgttagtcagaatagcctcgaactcctgacctagtgatccacccacctcggcctcccaaagtgctgggattataggtgtgagccaccgcgcccggccggaaaggacttttatatcttgtacacagtaaatgcttgataggaagttttatcactttgtaaatgaatcgtattggctagttgaatgttggtatgaaaagcttgaagcttattgaaattattgttttggtttagagttaaacatgaagtttctggagagacagtggtatttcaagggggagctcttggcaaaacaccagatgggtaagtatgctaaatccattgaatggtaaacatctttaaatatatatatgcatttattagtctggtaaatagagcagtcatgaagttgatttctaccctcttaggaaatgttatctattggtggaagaagaaaacttacatggaaaaaagtctgatgtctttttttttttttttgagatggagcctcacttttgttgcctaggctggagtgcagtggagtaatctcggctcactgcaacctccgcctcctgggttcaagcgatagattctcctacctcagcttcccaggtaactgagattacaggcacctgccaccacgcctggctaatttttgtattttagtagagacggggtttcactatgttggtcaggctggtgtcaaactcctgacctcaggagatccacccacctcggcctcccaaagtgctgggattacaggcgtgagccactgtgcctggcaggctgacgtcttaaattgagtgtcctgggaaacaaactctgagttagatttctgtgtgggaaatttactggggagtgccctaggggtcactctggggggatgaggaggcaggatagggcctatgactgagggaggggcggaactgctaccatcgtttcagtggataccagcctcttg

SEQ ID NO: 16713 - DNA, 1132 bp, Homo sapiens
atggtttgcaagctaagaatggtttttacatttttaaatgtggaaaaaaaaatcaagaaacgaataatgtttcatgacacaaacattgtcgtgtccatgttttactggaacccagccacgctcattcattgtgtattgtctgttgctgcctttgtactgcagtggcagagtggagtagttgcagcagagaccaaatggcccataaagcctttttgtttttttacagaagtttgctgacccttgttttagatcatctgtgaataaatttcacctgttttgtacttgtgtatctttgacgaaaatggacctaagattttgttatctaattcattcagctttcattttgttttcaaataatggcttgtttttttctcaatatccatcaacagattgaacgttcttttaattttaaaagatgttgtcatcaggcacgtggttctgtgtcatgtatatatttgttttttttttatactgctcagagtctgatgaataacagtaaagaagaaatgcgcgaactggcagcgttgttttattctgtagtggtatcaacagtgtcggggaatgagttgaaatcaatgatagaacagcttataaagactacaaaagacaatcacgtatgttattttgttttcattcttttttgtgggagatagggttttataaaaggatctaacttatttttgacttttatgttctcatttgtaaaatgaacttacaaattccttgcttttatgaccataaagagtaaatgagataggtgatacattggttcagtcagctcacttaacagatacgggtgctgtgtctgataagcactgttttaggtgctaggagtacagtgattcataaatacatgagaatccctggtacaacaggatgctcagagcctgcagccgtaccaccgtgaacacacctaatctcatctgatcttggaaactaagcagggtcgggcctgatgagtactgaaagcgagaaatgttagctccttttttcttcctcatctactgctgccagtgaaaaaacaagttttacttcacatagtttgttggttaccttgtgtttggaggttttggcaattagaaataggatctgtttattgtcttttgttggcaataggaagacattatgtgtg

SEQ ID NO: 16714 - DNA, 2243 bp, Homo sapiens
agaatcaagagaattggttctaggaacctgggttcgttcatcattgttgtttatttttttaaaataaataaataaatatatatatagatgctctgcaacaaactctgtgacagtatccttcagtagagaaagtttcttacttgtgagtacactcttttagaacatttacgggtggcagcagctttgctttagagtttagaagataatagaaggaatgactattcatgtccaaagtgaatggttttgtgcagtgaacaacacatggcgaggtactaactgagaaactttttcatgctttatgcctacctcttgtagttgttgcagagcaaatataaattgtaataagatagctaggccttgcagaaacaaacagaaaaacttaaaaaaaaatgatataagagctggagtctagtatttatatgaatctgtgagagataatttttttggtctcactgcaatgaaccaaaagcggctgagtttggtttttaattgtagccatgtattgaaggcatctttttgaccaactcttgttggttctgtcttgaaccattgttaatcactgtgctgtaattagtatagctaaatcttttccttccttgctcctcccccagcccaccccgtcttcccttaacattttttcagggggggttgggagtggtttcattttagtgtgagtggatgttttgatagttgtaaggaaaaaatgcatttcagacacatttcacacatgagctattttcttacacagtatgtcttattgttaataagaatgtaatttcatgatacaagtatttaataccttttttaagtcagtaaatattctagccatcaataaattgcagtagagtattaagaggggacaggatgagtttactcttaaaattaatcagtatcaaactaagtctactgtgtgtgttttttttttttgttttttgtttttgtttgtttactattatagtaagtctagtcttatttaaattggatttttgtattcaagtttatatgacaaaatagactagatcagcgctggttgtaaatgcatgctgtacctcactgttttctccccatcatgccgctaaacttgctcgccaggttgtgcttaacttgtggtgaactggacttgattctgttttgttttgtttttttaaaaaaaaaaaacaaaaatgtaagggacagtgcataagccttttctttgttaagtagtggtgttttgctttttcttcaggattggatggcatgttgtccacaggaatgcctactgcagggctaacactggcaatatggcagctttaaattctgagttactacagtctccatgtcaaagcataatgtgtagcatatcagcaataactacatatttatagaaaacactttttcactttactgagccaattcatttaattgtcaaatgtctatatccatggtttaaatggcaacatatctataagtatgtatacacattatatttaagcttttctctgggccaaactgcttcatccttttttctttctttttttttttttttagccttatgatgaatttgtttgaagggcattttctttatgaacaaaggcttggatgcatattcctttctttctgtgaatgggtattattccctgaggaaagttgcacagtgaaaaccagtctggttgtgacccactacatgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaaaaaccagtgtctagaatatataccatgttttattatttaaaatcattgtcttaaatttttgttcaaaaaataaaaatttgaatacaatcaaaacgttagcaatagtgtattttttgttcttctgtatttttataagtagcatgttccaccattcacatcagaattattagaagagttctg

SEQ ID NO: 16715 - DNA, 3270 bp, Homo sapiens
agatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaatttttctgtgtt

SEQ ID NO: 16716 - DNA, 1019 bp, Homo sapiens
tccctctgatgttttcacagcccttctgttacagtggatgatctgaagaaccttttcatagaagctggatgttcagtgaaggcttttaaattctttcagtaagtctttgctttcaagaaatacattaaaattatttaatatggtatgcaaattttaaaggtagttcagtgaagtcttctggtggaggaaggagtttggaagcaaaattcattctaaatactttctgtatttcttataccattttcaggaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatcttt

SEQ ID NO: 16717 - DNA, 1726 bp, Homo sapiens
caatttatatttagttttcagttatggaggggaaactacagtcttcaagaatatcaattctagttatagattatgaacaaaaatacatttttgtttaatttgatattcacttggatatcgagctacatagcatctatactactggttctgaatgcaacccacagtattttttagtctggcaagttttacaaatcgtatttaaagttttgggacatatcctcagtcaaaaggatcaaatttctatcaacataattaggaagtttctgaagtaaatttatttagagatagtaaaggggaaaaatggtaactaaggaaagaggcctacagtaagtagatgtagaaattcaaacttacttaaatgcaaattatttgtatttctcatcttgcttactcttctgaaaaggaactcaagcataaatatttaaacgtttcacaaatttttattttacaaatcatatttaccagatcatagttgaaaaagttcaaattttagatgttttttaaaaaggtacagtgtgatttgtcttttttttgtaatgttgaattatgttagacttctaatgtttgtcttgatattacactggaattagacagcatttttaccatttatacattcatttcaataagagctttgaaaatgctttggcattgtttgtttgtgataagtagaattaggaagatatcagcaatatagattcctaacagtaattgtgtatactgtgttttagtgatttttatgtccatttattttctgtaattcttttataaatcccttagtgtacttccactagaaattaatttataattgtttatttatattggatgaagtaggaggtccatgtttagtattaacccactcagattaactttatctaactgaacttttatatctataacccattagattgttacaactttttaaacagcatttataatgaaataacttttgttttataaagcatttgttacaaaaaaaaaaaaacaccttgccaaaaatcattacgatttctatgcattgtgtaatattcagtgatgttgagattttgcatgttgttacaggtgctctttcatatgtgtgtttgtggtgttgatgtggaattgttaaccactgctgctatcacttattgtagttaaactgaaaaactgtgttaaaaggctgtgccagtcaacatttctatgtgtgacttaagtaactgtgtacttcattgtttaatattttgagccagcacttagtggcctctacagaaggaaatattgtagttgtcaaagtggtgccaaacttgaaaatcttgtgtcatgtttataattccaggccaggtcagcttttcttcaacactttccgagctctttgaaagcaaaaaacatttgcaaaaagagaaagaaagcaagaattctgaacttttctaatactctctcctctagaattttaaatatttttttcttttgatgtttgagtatcttacagaaaaatccaatcaaatgactagcggtagaatttcccttgatctggatatttttaggctgaacagtgtaatagcagaggactatgaggtgcatacattatttttgttggctatcatggcttattgtttgaatttcatttaataacaatattcaggctggaggtggtgactcacacctgcattcccagcactttgggagactgaggcgggcggatcacctgagatcaggagttcgaggccagcctggccaacatgacgaagcc

SEQ ID NO: 16718 - DNA, 1204 bp, Homo sapiens
agccctactttctgtctatcccccccaccgccggcccccggaatctaagcagactccctgttggaagcttactctggcacagaagctaggatgtcaccttaaagggtgtgattcaattgaatatagtttagtgcggtaccaggcacatcataagcatgcaataaatgttagccagcttagttataacttttggtaataattaatattatttaactaatttgcattataccacttatttcttccattatggagattctgtctcccttaaactgttaaacttgaagaagaaaccaaacatgataatctggtcaagttaacacattttcgcccatgaattctacctccaacacagccaagctctgatacctcagatataagcaaaaacaagtgaaggaagaacagaaaagccttatggggctttatgagaaggtttttccattgtttagtgtgtttgcaaaaaggaattttatggaagtacctaaccaaagctgtgacagaagggtctccttggtcatgtggcattttccagctttccttggattttatgctacattaatttgccctggctgataaatggtgtttgaagaaatgtgaaattttgttactttgatttttattttaattcaagcttattaaaagcatcaagcattatatgccacactcagcattttcatagacatagtcattaggagaatctggacaaagtaatactcttgtagaaacggaagcatcttgctgtacttgaaagataactggactcagagctacttcactcctcacttgggcaaatgccgatatcactttgcttagctataaagtgccatcagtgggatggatcgtcttcacggtgaaccgtgttacacttctgcaattcctcaagttcatattaattaggaagtggcagagctaggacacaaaattcctaattcctgaagatagttagtctcctaattaagtgcttctcactatattgggatgccttctttaggaataagactttcctttaattttcaagttccacaacttctaaaattattttgctatctcgaagcagcagaatattgatcatttttctcagtttaggctaacacagtccacaccattaccacttaaataaagtaaccgaatgctaaatattatccttatcaaacatccatcactttgttgcttttatgagatgtagattgctaaaaacttttgagct

SEQ ID NO: 16719 - DNA, 1863 bp, Homo sapiens
agcacaaaagagatattccctagaagtgtcacacggaggcttctgtgccaaagactgccttgtagaggtctcatcacctcacacttcttgacttcacaaaattgtggccctgagatcagtactcctctcttaagtatttattattattattatttactttacctcaagcagacagacataggttttgaggcttgaatacatggcagtggaatacaaggccctccctagcagccgccccaggcctggaaagtgggagatttcattcgcccgggttaaaaatccagaggaagacagaagagaggagtcctaggaactgagcagattttagagacgcaaatgatgtttaagagagccttgtgatttgtagcaagcatgggcactgctttttcttactaatgtggtagatctacacgaacattctaggctgttctgctcagagcgaggaaccactgctcctcaatggggagggaacataccacccagccaggcttagcattgggttttatcctttaataaaagttttataatgaatcctgttcaccttaaagtgtgattatggagatgattggctccatattccaccacgtcattccttcaactcaccagacacctttctttagttgaaataaaccagcatgacctggagatcatggtgactgtaagctaagtctgttttcatgccagatttcagccccacccagagtgtgctctagatgttgttgatttgaatggttttcccagttcccactccacatggggaagttgaatgaatgcacacctgctgctcacttcttgtgaggctgccttttgtgatcaaataacaggaagttctgctttagaggagggcacgatgaccatgtggcagtctgcaagtggaattttgggatggcagcccgaggaacatccagagttactgtgtgacttggtcctgccatcgttagctttgaaatcacaggcattgggctctgttttgacaccattcattggactgcgggacagtcattctttacgttctctcttgagctggtgagagaggaggaagagggaagtcaagagcaacctccaaggcctatgtcagcctcttctccttgggtcttggggtgggttagaactgggttccagtctggccagatgggttgctggctgcactgagggtgattcttctcagaagatgggctgcctgtggtcaggacagggcataccagtctggactccaccttcccagacacctactttaaggacctgtggaaactgggtgatccaattatagggctggggcaaccctgctttggccaccctcatttacaaacttaggttgggagcttgggtttcctgtctcacttccaaaagccttcaagatggcagcagatggacacaccctctcatttcttgtgtcttgtctgtcagatggcaggaggcctgtatcagtaaatttgaggaaaatgttctctcctgggccagcctcacagcttgcgttgggtgtgttggaattgttctcttcggccttgttctgccttgtgatcttttcaattcagtgaataaaccaggaatccattttttcaccaacccaccctgtagattgtcagctttttgtttgagagatgcctggtctcacagttacatgtatcagagtgtgtgtaagttgtctgtgttagaaaggttggggtgggggctttgttgcaggggattagactgttctttcttcatcataatttgagatacatcctgagtatgactgtctaaccctttctgtgtggcagaaaaatatgttttccaggtagtttttactactacagagagtctgtaaataagtgctttaaaaaaataacaaaccaataagatatttgtctcctatataaacat

SEQ ID NO: 16720 - DNA, 1440 bp, Homo sapiens
taatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacgtagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatgggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaacaaatacattttagtaaatatatatttttaaatagtctatgactgttctgttctcctaattccaacagaaagcacatgaacccttgtaacaactgcaggggctgagtggggctaatagaactggtagtactctttataagcctgtctgaggacagagtccat

SEQ ID NO: 16721 - DNA, 1096 bp, Homo sapiens
agtagtttgattgttgagagagacctttgatctgcagtgtaaatctaccagtcatgggccagaagggcaaaagcccagctttctctttggaaagactcaggctgtggtttgttgatggccaggttttcctcaggctccaacaactgtgcttataccaagcagatcctcatcctccatataatcatctttgttattcgtgggggtttaattacattacaagtggccaaaacccctgttctcagtgaagaaccacattggatttgtattctgttcagttgtagtctacactgcagtcttattcctggttcaaactacctctttaaattgatttgtcttgtgctggtctgttaaatcctgccctccttggtgctagatccagttgtgcctcagggcagaggaaacaaaacacagctatcctgttggcctgtgttgtggttttgaagtttgtactttctctgtgggtgccagttaaatattggagagcaaggaatgtggacttgtatggctttgaaccaagagagggttatgagcctactggattgaggttaaaatccaagaaccaacatttagagctttgtgcttttctctcattccatcactttgtaatgatgatacttaacatgagcagggtgaatgacaggtactgacgaagtccaacacaaaggtataatacagcctgttgtctaaagccaaggagtcataaaaccatgagaaataaataggaatcaatagttagtagtgacattggtgctctctagaaatctcagcatgagctgctatagaataccctcccagcaacaaaacctaatcagtaaggccagctagacccaatggctcatgcctgtaatcccaacactttgggaggccaaggtgggaggatggcttgtgtccagaagttcgagaccagcctggacaacatagtgagatcctatctctataaaaaatcaaaaattagccaggcatggtggtgcatacctatagtcctggctatttgggaggctgaggcaggaggattgctttagccctggaggtcgaggctgcagtaagccatgattgcgccactgcactcagcccgggtgacaaagcaagaccctgt

SEQ ID NO: 16722 - DNA, 1122 bp, Homo sapiens
ttaaggtttcttcactacttctatggtagggttgtctgaaattccctttcaggctgtgggtactggtcttgggttctagtcataaggggttccttataaggagcaggcggaggggagtacactttcatgtgatttaattttgatcctgccctctccagctgctccttcaaaagatacatcaaaagatagaaactctgggctgggcacagtggctcacacactttgggaggccaagcgggggtgcagatcacctgaggtcaggagtttgagaccagcctggccaatgtggtgaaaccccatctctactaaaaatacaaaaattagctgggcgtggtggtgcatgcctgtaatcccagctactcgggaggctgaggcaggagaatcgcttgaacccaggaggcggaggttgcagtgagccaagatggcgccattgcactccagcctgggcgacaagagcaaaactccgtctcaaaaaaaaaaaaaagatacaaagtctgcatttgatataatgccttaattactgggtctacaattaatgttgactgttttagattgtaagctcctggagagcagtattgctgtagtaggaatgttttaacagtgtcatatgaaaaagaacaaaataaatattttgattttgtgattctatgcaagtctttctgcccagagtgataatgcaataagctagtcttttcatagtctgcatagagtctggccattaccatcagtttttaagatgtccatattgtggccgggcgcggtggctcacgcctggtaatcccagcactttgggaggctgaggcaggtggatcatgaggtcaggagatcgagaccatcctggctaacacggtgaaacccgtctctactaaaaaaaatattaaaaaattagccaggcctggtggtgggcgcctgtagtcccagctacttgggaggctgaggcaggagaatggtgtgaacccggaagtcagaggttgcagtgagccaagattgcacctgggcaacacagcgagactccgtctcaaaaaaaaaaaaaaaaaaagatgtccgtattttaggtggtatgatccttttaggttttcatctcactctccccctactcgacttaaaatgacatgcctagta

SEQ ID NO: 16723 - DNA, 1143 bp, Homo sapiens
agtgggagaggtgcaaataagctacagtccacgaaagcgcttagggatcaggaaaacggtggtccgctgtgtaggacaccgctgagtcccgcagccttcctcctcagccctccaccgccttctcccgctccttaacggccccttcccgcagagatccccttcccccttagcgctccctgccagagtgagctgggatcccgggctctgtaccgtggaagaggctcgcgaggaagccatgctgggctctggagccgcgaggccccagcgaaacccgaacactccctttcagaccgtccaccgcgcgcccagcagaggggaagtgcgtcactgacaggaagtgcgtcactgacaagacgtgggccaagaggggtcaccgcccccggagcggcgcggagcatgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagaggtaggtgagtcgactcgcgcggctcggggctgaactctggagcgagtcaagggcttccggggtccgctgtgccccccgggcgtacgggggcgtttacgtcttcttggagccgaggaccatgttaccatagaaacccttgcctgggctccgaggtacaggcctggagctaggggacgaggactgttctcctccatggtccggaagtcttcccaggctccccctctgagcttgatggctcggcggtggatttgggctgcggcgggagattaagctagaagagcccgctagtgccaaagtcaaataaagacccggcggaggagcttcggcctgattttgttgatttgtcttcagcctggtctttgtatcagattgagagtaagatgatggataggaaggtgtcaggtaactctgtacgtctctctgccctgctggatgctggggcattagagacgaacaggataaggtttttatccccacatgggcggtgggagatcctcaaaatattgacgtttccctagctggccagatcctcatgcaaccccct

SEQ ID NO: 16724 - DNA, 1193 bp, Homo sapiens
tagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtct

SEQ ID NO: 16725 - DNA, 1189 bp, Homo sapiens
cacttatattggaatttaaaatggtgtcttcattatttctttcattattctgtttcttctgtgggccagacactgtgctaggaacagggttagtgaccaagaacatagttcctgtcttccaggacctcacagcttatgcttattgtatgttcatatgtgtaacatcatgtggagaaataagcattaccttttgctttatgtagaatttgcattgcttttgaaggaccagttgttttctagtagcagactggtataaattggagagcctttggagtcagttatactcaggttaaaatcatggatctattacttaccagttatgttatctcaaggaagttacttaagctcttagagtgtctgtgtcttcatttataaaatggggagaattctatcacctgctaaggttcttcagaggatgaattcagatactagatgtgaaatacctgacattgtgtctgacccatactagatgttcttttagtggttgtcaaatttcagtcccagtcatcttttctaattttgaagatgactgccaatggtcagatatgcttgccccatgccctctatattggtggaggttactggaagaaaagaaaatcctgttatttcgggttattttggaaactattttatgcctatccagcagggacctgcagggataaagagaaacatgaatgctcttcctgatccccatgaggtgttggggctagagtttcagtgaacccaccttacaacaggagctgttctatctgccacacagctggggtttcaggcactcttagggtgcctgcatgtattttggtgctcacaactggcccagctgttatcttgctgctgataacctaggagatgcaggtagagcatgactgataggtatctgcaaaacctaagatgcctgtaaatgaatttgctagttcagaatccttgagaagaggcacagtgatgctagttagcacatttgacaggaattacagcagaggaatgacttggtgtggagaagttctgaacattttgctttttctaggtcactcacctgtgctgggtccccagagaaccatacatactacagacctctgaagataaaaccctcaggtgggcttactgagcagctgtgaaagtgtttcttgtgaggtttgtggctcccatgcatacatggctccattcccactctgattctccacattgctct

SEQ ID NO: 16726 - DNA, 1111 bp, Homo sapiens
ataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttct

SEQ ID NO: 16727 - DNA, 1344 bp, Homo sapiens
acaagctccgttttctcatctgtcaagtagtggtggtaatactatgtatcttacaggttgctacaaagattaagtgagttactgttagtaaagtgcttagaacagtgctgaacttgtagtcaatcctgtgtaagtttttgttagataaaatagaaaactggctgggcacggtgactcatgcctgtaaacccagcactttgggaggccgaggcgggcagatcacgcggtcaggagttcaagaccggcctggccaacatactgaaaccccgtctctaccaaaaatacaaaaaaattagccgggtgtggtggcagatgcctataatcccagctacttgggaggctggggtaggagaattgctagaacccaggaggtggaggttgcagtgagccaagatcatgccattgcactccagcccaggcgacagtacgagactccgtctcaaaaaaaaaaaaaaaaaaaagaaaaccatacattccaaaaatagcgattgagcattagctctgtgctaggggctgggaacaccaaggagaagcacccacccctgtctagatggtgttgatgggatgccagggaagacttggcggagggggtgatgcccacacggtatcctgaaggaggaatgggcctgagccaggcaaagaggagcagggagggtgtggctagcacttcatgcacagggctagcaagtgcaaaggcctgggggtcagagagagcaggatgcatttgaagagctgtctagcatggctggagcacagcacaggaagagttcatactccacctgtttgtctgtccatgtgtccatccttccatccggcacatgaatagttacatgagttgctgtcatggcccccactgccaggactcttctgtttagcccagaaggccctgtctatctctccagcctccctggctcttgccgctgacggtaccctccacctccagctctatccagttacatgcactcccttgaatacatcttgcttgctcctgcctctgtgcctttgcacctgctgttcactgtgcctggaataacctttcttttgttttgaaccccttttgaaaaataactctccacctgctctgattttgcaagaaatatgcctgccttcatcatcattaagactcaggaaggaagggtcattttgccttattatttccccctccaggaatcatccccctgacccacctgtctgggctgggtttattgctttctcctttgtgtctttgtcacagccctgactatactgtgccacctgtgtctggcctctctgccagactgagaatgcaatgaggacagggactgggtgtggttcattgtcactgctggccagagagacccagga

SEQ ID NO: 16728 - DNA, 1158 bp, Homo sapiens
ctccctggggtgtggttcagggatgactgggacctgcccaaggccgcgcagtcctctgggaggaggcagggcttctaacacagtgcatttgggcttcaagttcatggctctttccagttctcagattacaggcagcaagcagccaagtaacagagaattcctatttccaagtagggaaattgaggccaaagcagattaaggttctcagctgaggtgatgctgtgagctgggggtgtggtctccagtgacccagatgtgaaccagagctgacccaggctgttggtgcccctggaatcctggagagaactctgccttcctattttctccttgtcccctgaggcgacttttcttgagtagatttcctagtggatttcaggagggcagggtaaaaacatgtttagaccacgagagaaaggggctgggaaagttcaggggtctttccatgtcagcacgcttggagcctgcacacctagaaaagaatatggctgcttcgagtgcagcaggaaggatgcaggttagacttaagcaggaacttccaggccttggagaatgtccacctggtaagaagttctccaagatccttttgcgggcttctcctagaggttattaaatattcccactcttgatataaaccctaactagtgtagtgatggcacattagagttgaccaggggctgcattagaaacatctcaccgtttcttcagcccagccctgccaggtgagtgggacagtgctgactgttttgcaggccagggacctgagccttaggagcatgagggggactttggattctagatgtttcttgcttctctgcccctgtatcctacccgctggagcacacggttggggtggacacttcctggaggcagaagagtggaggagatggccttctgagttctccttggcatcctgctttggatgtggtggcgaggaccgtccctgtcctcagctctattcctctgagttgttgtggccaagagagaatgcagagtctcactccttagccttgttctatctcctcttgggccttgttctgctccaagtatgaagtgttcagttctccagaggggcccgacctgggaaagtagagaaaccacgtggctggggccctggcagggagccaagctcattccttgggcctggggccagcctgctgc

SEQ ID NO: 16729 - DNA, 1351 bp, Homo sapiens
caatatcaacgccctcccagatgtgtccgtggtaaggccctggctggccctttggttctgctctccctggtgtgctcaggtcctggtggctctctcctctccatgacagccacggagaaagggcacagggtggcaaaggagacagaggcctctgccatgagctctcacacccagctacaggtctgtgcacaagctcaccattctagtatctctagcaggcaccaggatcacttgcctctggtgacttcaggcggggccttcaggctggctggccacagtatgaccaagtttcttagcctctctgtgcctcagtttccccgtcggtaaagtggggatgatgatcatagcatacctaccccataagttcgtggcatggagtaaattaattaagtaaagcctttaggatggtgactggaaggttgttggagctgtgcaggtgtccggtgttgacctaggcagaggggagtggtagtcacagtgtccatagctgcccctcactgtgcacctgctgtggcgcaggcactgtgctaacagtattcacgtggcttttgacatcaccacaccacctctgctgggtagatgtgcttttccccattgcccagaggtgcactcagagaggtgttgtgccttgcctggggccacatagcaccccagcccatgtatccatctcctcctgtccattctctctccagtcctttcatacctcttgcctctagtactcaagatcaccccctaaaaagaaaagccaaataaatgcattttttgtatttccatcctcttcatcgtgtctctaatgaagtcttgttccctgtgacaagctctggctgatgccaagaacttcagttcccaaaggtaatgatgctgtccccagagacacccgccaagatcccaacgcttatcagctgccgagatgcaggggagaagttttccactcaggtgttgcattattcagagcagtgtggccaagagcagttagagtggggacagaattccagctgggcctggcaccactcagctgctcggcctcccctcttccaggcgtgatggggtctgactccttctccgcctgttgggtcttttggcaggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctc

SEQ ID NO: 16730 - DNA, 1435 bp, Homo sapiens
cgtatgtctgcacccagtcctggtggggaccaggggttcttattggtgctgactgtctttccaggtcatcaggtttcctgagctctgcagtgagaatcccgtccattcaaatcccagctctgccactttcttgctgtgagacctcaggaagtggtttcacctctctgagctcagttttaggatctgtaaaatgaggatggtaatttctgtcccgtgatgttgagagaccccttggcctttgcatatgccatgtgctttctgtctggaatgttcttctccccacttcatatgacctgactttctcctatgtgtgcttcagccctcagctcagaagctgcctcttccaagaagacttccctgatcctcccaaggggagtgactttcaggccacggctcctcttgcccccgggcttcctttggtcacagctcttgcctcattatgtcctattataaaagcctgtacaggtttcccagttacccaatgtgactgctgactgcttgagggcagcgatcgcacgtgcggttaccattgagtccctatccctagtgctcagcacagaccctagcccataatttgggcctttattaataacaatagtggctgagatttgttgaatgttctctatgacactgtggtagtgctttccattcgtatcttctttgaccatcccaggagctaggagttgtgagtactgctgtgatccccattttacaaagaagaaaaccaaagctcagagaggagaagcaacttgcccaaggttgcatggctagtgagtgatggagccaggattcaaacccaggcttgcttgactctgagctctgttgttacccctgccatctggctgtgattcttccctgaaggatctcaccagctccctgttaagcatcatttcgtcatctatctgcctctctcctcccttccttcttcttgtccttcctttctgttaacaaatattgagcatttactgtgtgctatgtacattttgaggttctggggatacagtggtgaacaccaaagaaatcctttccacgatggagttgaacagacagcaggaatgccaggcaataacacaggatatagataactgaaatacacagtaagctaaatgatgacaagtgctagggagaaaaataaagcaggcaagggagactggagaggggtggggtggttagggagtgacccttgagtcaagacctgcaggtggtgagggagagagccatgccaacatctgggagaagagcatttccaacagaagcagctgcatgtgcaaaggccctgaggtaagagaatgtcagagaattccaggcggccaataaggccagagcagagggagtacgggggcagacatgctgaggactttgactctgagtgagatgggagtccttggcaggtaagagcagggaactgatgtggtctgacttcgatttaacaggg

SEQ ID NO: 16731 - DNA, 1216 bp, Homo sapiens
ctgcctatgtccttattttattctaggataccacattgcatttagtagaagatgtgttttcagtcttaacaatattttttttcctgcgatggaaggtggggtgagggggaggagatcctctgagcttcccaaacggagagattcagtgtgtgtgtgtgtgtgtgtgtgtgtgtgtgtgtgtaataaaaattaaattaaattaaattttaggaatcaagttacctaataatttatgaataaaggaaagttgcagctttttaaagagtgggtcgagcaaagttttttccacttctctttctgataaatcaagcatccattgttacctgaagcagttcagtgaggatttgatcctatatccattggggcttccacccctctcttgaaacccatttgcaaaatcagcagtgacaggtccagataaggtaagccatggactatttgcaattatgttgaaatgtttgatttttgaaaaaatatcttgaacaggagccaaactaataataataaaaaagtagacctttcaaaggtttttagccaaatgtgcttgataaattggccagagagtccacagaccagggatgctgccttaggccctgctgcatacttcctgtgtgaccttgggcaagtcactgaccctctctgggttccagggtggatgggccaggagctgtccaagatcccttccagcttggacagtctgtgatttgcttggtatgtgctacacaggaggcatttagaatgtctaatctgatgtcttcttgttcttttgaaattgctttcatttaaggcagaataaggaaagttggctaaggattgggagatgaggatcttggcactcttgtgtagcatcctactatatcaggaaattgatgggttatacactgtactgacgagagcttgactgctgtctcttgacccacaaacaccaaccctggtgctgtttcggagcaaatgaggaaacaataggattctggcacaaacagcaccgccctgggagcattcaaaatcaaattcacttgctcacttgccttctgaatctcctggttatgcggtagcagaacacagggtagcggggcactgctgggatatgtgcatatatgtgtgtgtttcatctcaataaaaattaaacggcttccttatggcctcagcacccccatgggtggattcaaggagcatattagaattgaaatattccagaagttaaaaactgttgccg

SEQ ID NO: 16732 - DNA, 2168 bp, Homo sapiens
ggaaagactggacccccattgctttcattgttcagagaacccaggagacatgaagatgaccagactgggcaaattatgtgtccaaaacttggcctcagatgatgtttccatctccaaccccttcatgccagatggggaaactgaggctcagagaggatactgctctatgtggcattgccttgaacccctaaaattatcagacttcctttttccaatataaagaaaaaaagtaagttttcagaattctctcaatttttaagtttttctcccccatattttgtgaaaagcagtggtatgtgtacgtgttgtctaccagtacacaggctgcagaagacagagacagaagaaagagatcaagggcagataactgttgataggaatatttgagaaagattgatcctgtttgacttgaggacttattttgttcacaggcatgcacgcttgtggttgtggttttatattacagatgtagaacaatggttatgtttcccgacatgaacattgtcctggaatgaagtgtgatcagccacttgtggaattctttgaagagctcagaggcttccaagtgatctgctcctgaacaagtttgaagacctattgtttcatagacccaagaccaaacgcatctaaaggatccccagcccccaagacctagcctttgtctgcgattttggcttcatctcccacaaaacccctttatgagttcacgctctttcctggactgacatacctattcctttccatttgttggactcctattcatgcttcaaagtccagctttcttaagcccttctttaggaagccttcccacacagccaaccctgctgctctctgcctcctttaaattcttgatacagctgctgcttgttctgatgttttatggtattgattctgttttcctgtgtatatgccagtttttctagctagactgtaaactccttaaggacagagactacaccttgtactttttgtgcatgacctggacctgctaaggaaaaaaaaatcttgtggattgattgctttgccatccccacagcagcttttgcaaattgctttccaaactcacttgaatgatgacattgctgtggacctgggttctggacctgatctgccacttcaagctgtgtaatttttggcaagttgctttctttgcctggtcctcagtttgcccatcaatataatgggtggattggatgatttttttttttttaattgagatggagtcttgcactgtcacccaggctggagtgcagtggcgcgatcttggctcactgcaacccccgccacctaggttcaagtgattctcatgcctcagcctcccaagtagctgggactacaggtgtgcaccactactcctggatatttttttgtgtttttagtagagatggggtttcgccatgttggccaagctggtcttgaactcctgacctcaggtgatccacccgcctcgggctcccaaagtgctgggattacagacgtgaggcaccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccccggtaagtaattaacagagaataaaaatgtgtttgttaaatgacaaagcagcagtttttcaattgtaaggtctgcttgagagcctttgatgtgtgtttcttttcctgacttttcctttctttagaa

SEQ ID NO: 16733 - DNA, 1188 bp, Homo sapiens
cccctgcacctgtcacaaagtatcttctgcagatagcaaacctgcaagttgttccattgataagtaagagtggcatccattcctgaggaccagaggagctggcctttggagagccctgcctttgaaaattcacgggacagtcattctgcacacatctgctgaagaaagtgcttcccctttgccagatcttatgccagatgctaactatgaatgtatcctaaagatgctcttatactagggctgtgaaataaataagaaaacagctcatgatacaacctcagatgaatgtcctcagatcagaaaaaagaactgctatgatcatcagctctaagacccatctactaggcatagttccaagattgcccatttctatgagtttttaattgtttgcatcacattattgcacctggaaattccccaggcattctagtccatagagttaagctaagaattaagctccagctcagtcctcctgcactgagagcatcaccatttctccttattccacagttggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgagtaccaccagggactgcagagccctcaggcctaggggaagagggagagggcaaagcaggggaggagaagagggtgatctcctcctgatgcactctgacacccccatgtgtgaggccttgcaagatagtgcctgtcacacagaggcactcaggaattctctcttaaacaaaagaatgggaaacacgctggctactttttgaaacggggagataagtttcttgtagtttatctcatccaatcctcatcaaacaactctgtgatgtataaatgacagttgatcattgaacccattgcttacattaattagcactgactaagcatttattatctaccaggcactgtgctaagagtttaagatgaattattccgaccccattaccataggagctgggtagtgtatttttgaattaataaactctatttttttagaacagttttaggttcatggcacaattaagtgaacagaagttttcatatacaccccacacccacccacacaacctccccattatcaatatcctg

SEQ ID NO: 16734 - DNA, 1127 bp, Homo sapiens
ttcattttatgttttaaatctgctttattcaaagtttactgatttaaatattaatctcatccaaaaaaaaacccccttcacagaaacatagaataatatttgaccaaatatctgggccccatggctcagccaatttaacacataaaattaaccattacaatcccattctcccaatatagtttggcagggccttgggcaggtggtagccttagccctggagtctacagcagtgctctcatccttaccagatgcggtctctccctccttatattattttaacttgctctgcaccttctggcccaaggacctttgcttgtgctgtactctccccatctctgatatctcagcagtgcacatggagcctggtagagagtgggtactcaatgaattcttgtccagtaagtaagtgaatggatgggtaaatgaacttataaatagaatgacttcttatctataccctgagaatttctgtgaccaaaagccattatactttttcttctgctcttaggaagtcattgtgggtccagataccacctcctacagcctggcagacctgagcccatccacccactacacagccaagatccaggcactcaatgggcccctgaggagcaatatgatccagaccatcttcaccacaagtaaggaggcccagggtgccatccagccttgagatctaactttgactgaatcaacccttgacttcccctttgacttctactttaaaattttcaaacaaacctctgaaaagaatcgattcactgctactacttggaagcctgaggaaagcaaatgtgggagattatgagcatcccggtgaaaggaaaggaggaagcccatctggattcagtccccatttctatcacctgctaggtgtgccttaagaatgctacttccatcctataatctttagcttcttcgtctatacagggagattaataataaatcctctgtcaccaggaccttgcaagtgttcatgaggtattgcatttgaactcctagcccagtatgtggcccatataattgtgtggtccttttattgtcagagttcaacatgagctgaaagtctctttctttctccttcatcatgccagtgtttacaaaacctgtccacattcaaaatcaca

SEQ ID NO: 16735 - DNA, 1204 bp, Homo sapiens
gagaattttttcctttactaaagttattggtatctaaacataaataaatggctttgtgttcaatgtggcgcaagcagggaagcctggttggaaagaacaccaggctggcagggaggagatacaagttctaaacttgatgaggtgagcaagcttggtcaaggcgttctgtcttactcacctctataatataagaaagttggaccagatatgcccaaaataccctcccagtgctagggacacgtaactcaaagttcagagcagggagtgaggctcagactgcactttcccatgccaacagcctgcatctgagctaagacccaggaagcacagaaagttggagaggccagaaacacccaagggcacactgctgacctgggactccagcctgaaggaaatggactaaggaacagccaccacaggtcttaagatggatcacagcagggggtccctgatgccatctgcattttagaggcaacagaagatcttcagacctctgtggctgacagtggaaaagacaggtcaaacaaacctagagagattttagaggacacactgttgacaccagatgtcctttcttattcctgccagtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtgtgagtgagcagaactcttttgggcagcctcacctgatgtcagcccacccagtgtataaccctccctcgccacggcccctacaatcctatagttgttctttacagttataccaaataagagcctagaattaagtccatagaatcacttattaaagaaatccctcattttccatcaaatctttctccttgctctcctatatacttcctgccagagaaaatcattacaagtaacatttagcaagtgtttactgtgtatcagactttgttgtaagcagtctacatattagtataagagtcctcatttggccgggcatggtggctcatgcccgtaatcctagcactttgggaggcc

SEQ ID NO: 16736 - DNA, 1206 bp, Homo sapiens
caaattgcaaaaggccagaggaataagaatatgacatattgctgaaatattagaagttcagtgattaggactttgggtgcaaaggagttcttgatgagaagtaaaatcagaaaaggagaattagctggattatgagaaaccctgcatgctacatatgagatgtaaacttcatcctgtaggtgatgagaagccactaaaacaattgacacaaggaatgactgtgcccattgtataactgaaaatgatggcttggtcaagcagtgtggaggatgttgaagaagatagtgagactgaccaatgaggcaaagagactccaatccaggcaaatagatagtccagcctagtggatgttttaatactgaagaagagttgaattgaaaacaaaaaaacttagaaggtagaatggactggaagtggagaccaactgatgatggggaaagagaagcgtgaagattaaaatgagttctaggcacttggtttgagttactgggagacactgtgacatcgactgcatgagaggcaataggaaaaaaagtttctccaaagacgtcgtccaccactaacttatagatttgggagggaatagttcttataactggacatgtcccttagccactggaaggctgagaattcatatagaatgcctatgtaggaggcaggcatgtcctgatgactacagtgtttaaatagatgaaaatattcagattgtctggaaaatatttcaccattagaagtgatctaactgtgaaagtgtctatttggaaccagccccagttcctaaacttcttgaaggcttttccttgcaaggaggtgaaataagcaatactaacttcaccctcacagagtcaggaattgtgcaagaagcaatgctgggaatagctaattcatctaagaaagtgaagctcagcaggatggcagtggtccatggaatcattgcttttaaaactggaataaaattagaatagtatctggctggattgcaatcttctactggactgataatgtaaatttctctgatttgttggtcagttgcagtgatacagtttttctgaccccttcagatgtgcgggttaatttcaaaatagaaaattactaaatctcagagcaaaatcacagactatagatgagcttctttaatctcttcttgtaaacagaaggttgaagtctaagaaatattaagaaactgatcaaagatcaaacagtaac

SEQ ID NO: 16737 - DNA, 1103 bp, Homo sapiens
tggactgctctggaaagtgtgtatcatgtgcaccagttgtgtggaggggtacaaatgtacacacatacttgtttataataatttttttaaatggaggataaacaataacaaaccaggctacatatagtaatggaaggggagagattggagtaacagatagaaggtagatttctctgaatagaccttgttttgtagatttgacttagcaagtatataaatgcattacatgattataaaaaatcaaaatgagaaaacaattcctaaaaattcttggcaagatgaaacaaaccttactgtatatggcaatgtaggcataacaacacaaaaaggaagcatttcagtgactaaagcatagtaatttgaccacacatttctagtagaagtattctaagggcaagaaaaaaatttaaactcttgttaatggttatatttttagtagtaatattgatattcatattctgaattattatatttctattataagataaagcaaatacttttattgggaactgattttttactgtaaggaaaaagagataagaaatcaaagaaataaccctgtaatcctaaatttgaatagcacatatcagaatgaacttgtgatgtattatcatccattaaaagaattttatgaactttgtcaacatacaaggctttagaaacaatgtctgttctagcaccagtgagtgcccttgatgcccaaattatggtttctagatacctttgcccgctaaagggaactagggttcccttggagaaatgggttgttgctaggtctggggcaggagatgtacagtatgagcctagaacgtatttcatcctagtaagaaaggatccagcgtggggaaagagggagagaaccctatggatttacagtggttcccataagtgtgggccctggacctgcagcatctgcatcacctggaaacttgtcaaaaattcaccttctcaggcctcacaccaaacctgctgaatcaggaactctgagagtgcaccccagcagtctgtttttgtagccctctaggtaggtttgagaaccactggatttaaagaaactcaagagataatcaaatgcaaaacatggatcttatttgcatcctgaa

SEQ ID NO: 16738 - DNA, 1352 bp, Homo sapiens
cctggaactagatcatggaaggtctcatgtagatactgggaatgtcgatgaattttagggggtgtgtgtgtgggtttatcatggttaaaattactttttagaacagtcactctgaggaagaggacaactgaggggtaaagagggaaagactagggctttttgagggaggcttgttaggaaagactggaggctttttgagggaagtgtgttaggaaatactagggcctttttgagggaggcttgttaggtcactgcagtggtcttggcttggctagggctgtgaggaaggagagagggtttggattttagtaaaagagatactgacataagtgtatttgattttcagactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccaggtacgttccacctctgccgtctccccgtttaagcctgtagtcccccagtattgccactaggtgggagcccatgagctaaaagagaacactactctgtgatgggtagagtgtgttctggggaaggcttgatggtggggttcaggcagccaggtcctgtggagaagggagaggtgaggccacaaagaagaggaacagcgaccacgcacttgaacgtcagttacgagtcttgggtcctctggaaatctgcagggcagatttcgccctcctcaagttgggggctcagggtaaaggtttcataccagtcacttggtgagtgatagtgcctttgctgaactgcagtgtgtactcctggactctgttactggcttttgctgtgctgtgaaactaaaactgatgtctaggcaaggtaggaggaatataaatattttccat

SEQ ID NO: 16739 - DNA, 1210 bp, Homo sapiens
gcctccgggttcatgcagttctctgcctcagccttcccgagtagctgggactacaggcacccacctccacgcctggctaatttttgtatttttagtagagacggggtttcaccgtgttggccaggctagtcttgaactcctgacctcatgatccatctgcctcagcctcccaaagtgctgggattacaggtgtgagccactgtgcccagctgagaatttgtgctttttttctggtcctttaagaaaatacttctttcatacaaccatccacatcataagaaacattatcttatgttattccaaaatcttcctattatttttgctttggtttctgaatgttgtctatgttaatctttttcttttctttttttcccccacggcgaaaaagagcccaggtttcttggtttgtttcatgaggtatgaaaattagctcatcttgcttctctgccttctcttctaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgtgagtaccgccctgcccttctgacacagtggacagtgcttttggggctatgtggctgtgtctggttgtagggtgatattcagtacagaagacttaagaaaatatttcacttattatctcagtacctagaaatgaccagcttcatttgatctatttggtatttcagtccttttattctcctcgctctctctctctctctctctctctctctctctcacacacacacacacacacacacacacacacacacacacacacacagagttgttatcgagttgaaaatacagttttgtatcgtgcttttttaagtttaatgttctctctctggtttgttgccatgtcatgaatgttcttcaaaaacaattttttttgtgccagcataatatttcatcacttggatgtattacagtttatttaactagttcttttttgaacggcatttagattattttactttttttttgccttatgacttctgcagcaaacatccttgtacataaatatttatccactgattctttgttgtttttt

SEQ ID NO: 16740 - DNA, 1302 bp, Homo sapiens
atggccccttcaagccggatcactactgctgctgagagtcaggcctgcccttcactttccagctgctgtccttgctcaggccccgcctcttctccctaagagcaaatggcaccaactttgtgattggttggttagtgtcccccatcgatggggctggtcactcagtttttggcctctgctgcatccctaacactatatcaagtgtggcggggaaattgagaggcccctcctcaagccctggtcatgatggaggtacaagggaggcatccacaaggaaccatgagttgagtggtcttggaactgctcactaagtcagtccttccttttttttttttttttttttggtatttttggtagagacggggtttcaccatgtgggccaggatggtctcgatctcttgccctcatgcctcggcctcccaaagtgctgggattacaggcatgagccactggcgcccagtcagtccttccttagtttggaagttggtagtggagtcacaaagcccatgtaccttaccattcaggtaaggttcctggtctgtggacttataccgtgttcctggtctgtggacttatacccgtggtttacaggttcagtggttccccagcccatgacagatgagaaggagctatattgaaaggcaaagaggaactgttgtttgaattttcctgagagcctggcttagggctgggccttctcttaaacctcataacaatgaggttggtacttttagtccctgttttacaggggtcagaatagactgtaaagggataactgagaaaggacagagaagtgacagccagaggggctataaaaacataaaagcaagcatagatctgctactactttgtaacaagatggttcctatcacaaccctggttcaaaaagagaataatatggttttaatgttaaaagaaagcaggaaggtgggtaaataaaaatcttggtgcctgaaaaaaaaaaaaaaaaaaaaagatgatactcaagcacagtggctcatgcctataatcctgacactttgggaggcccaggcgggtggattgcttgagctcaggagttcgagaccagcctggcaaaatggtgaaaccccatctctaccaaaaatacagaaaaatttgcctggcatcgtcgttgcacctgtagtttgagctactctagaggctgaggtggaagaatcacttaaacccgggaggtggaggttgcagtgagtggagatggtgccactgcactccagcctgggtgacagagtgagaccctgtctcaaaaaaaaaaaaaaaaaaaaaaaaaaaagatacttatga

SEQ ID NO: 16741 - DNA, 1217 bp, Homo sapiens
tatctgtcttcctcctcctaatagatgtaaggcccaggcggtcaggggcttttgcgttttttgttcactaaccctatcccctagaacagcgttcgggataaagaggtgcccaacaggttgtatgaatttggacacgtctcttaacttctctaagccacagctccctctcctccgtaaaatgaggataataagaaaaactactgcagagctggtgcaagatcagattggaggagggacataagcgcgctgtgcaaacctggatgtacggtacgaaaggaacctccgttctaggttgcacccagcctaagcaccgtgagggccgcgcggcacgcgttcagcttcccgggacgctcttctccccacccctactcccggcctccagcctcccaccacccacctccgggcggggaccggaagtgcagccgcttccgccgggagccgcggagctgagggacgcgcggagatgacgcaggcagcaccggaagccgctcccctgtgaggctgcggaccgggagcagcggccgcaggtccgggtctgtatgcgaggcggggccggtcggggaggggactcttaggcgcccgcggctctgctgacccgccgcgccttggctgtttttctttccctgcaggcgccatggctgcggagcggacccggccgctgcaaggctctggcggtccgagcgtgcctagtagctgtgaacccggcgcgaggtcccgggccccggggcgctcgctcaggtcagtgccgcgcggaacacgattccgagagcaagggacctgggagcaacgaatgggttgatgggatctggattttagagacgggaaaacagggttttggagttactgcctcctactgcctccatttccttagctgcgaaatgagttaacagtgatgtcccagggctaccaaacgtttgaaagacgatgaagtgtgatgaggtggtttatgaagtacaaagcgctatactgcgccataattgtgggtatgccatgaaaacaggtgtgtatgtggggtgctgcttgaagtaaagcaaagataacaatattaatgctaagtaataatggtaactgacatttactgtaggcttacagcgtgccgagtactgtgctaaacgctttacttgcactgtcttgtttaaccctcataaaaacccttgtaggtaatgctcttggctgtattttacaagtgaggaaacagggcatgagacaggtgaagt

SEQ ID NO: 16742 - DNA, 1197 bp, Homo sapiens
caaaaacataaataaaaatactagtaatgacatttacagtatgtttcacagattaatcacatctctgagtgggagtctttatctgttgtaggatctactcttgccattctattctgggttttggttgattagtctttcttgaacacttccagaaattggagatgtatgcctgccttaggtagcctagcttattttattaatgaacatatccatttaaaaatttcttcctggtaatgagtctaaacttgccttcctgtaatttgtatccactggtcctttttctttgttctccctcttgcatatgccagtacttcaatagctggtcccagctccattgacgccctctctcaggatcacacatcacaggtccttcagaatctcctaatggtctctctgatctccaggcaacacactactctaacctttctatgcttttctggcctgcagttcatttctgttcctgtgaagtcatagagcccgcaattcatgctgtcttgttcccctattaaaatatatttttgtaaatctctttaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggttggtatgacttggccctgttcagggatatcttaatctttgacaggggttcaatatgtaagttcatttgctggtgggttaactacattgtagaaactattttatgggtggcagtcttgttaaccatgaccttgtactcatgtctgaaaatctaataattattacggaaaacctttttttttttttttttgacttttcactggtttaggttttcattggtttaggtttctaccaatcgatttcaaccaaacattgtttcctgtttcccctctatgatgtcttctttgactagatttcatggtacaaagaccacgggctagagtcagaaaggtctggattcatgtccttgggttttctattctttttttttttttttttttttttaagagattgagagtgtctctctgttacccaggctggccccgaactcccgggctcaagcaatcctcctgcctcatcctcttgattggc

SEQ ID NO: 16743 - DNA, 1167 bp, Homo sapiens
actgggccggtttactctctgtcagcctctgctcagctcgaccgccacctcctccaggaagccctgcctgattctcctggttgaacatagtcttgcccattcctgtttttcccatagcacttggtggactcctgcactaaagcctgactgtgttatttaagcaggtatgaaacatttaggggaggattccttgtgtagaggcagcatagagaagatgccaccagctcaggagccatgggttagagcctggctttgcctcccacttgctgtgtgactttggtccaggcacacctcctcatggagcctcaaaatattacctattggtaaaatagggctatcaccgccacccaccacacaggatgtcacaggatcggggcgattacagatgaacactgtcaagctcagaagtgtaaggtttgggggtttattcccaggtatcacacttcaaggaacacagataaacagaagcgcatttaccccaaatgcacagagactggggaaagactgctcagtgtctttccatggaggcaggactgactccagggataggaggctaagttgccttttgtgacctcaagggagacagacagacttcagctcagtacaaagaaagaggagaatgttgcatcactcagagctccccagggtaggtgtggttgtttcatggagtaatgacctctctgccattggaaggacatggagccacgtagcatgaatccagtacagaacagaaattggactagacagcttaaacccttgtcactttctgagtctagacaaattaaggctttactgtgagctactggcatcagttgtcagcttgcttttgaccttcttgaatgggcctcagggggagggggtgggagaaacaatcccatttgctgatcctcagcagacaggactgaagattatctccagccccctggcatcccctccttcactgtcacttctacaggaagatcacgccaggcaagtatcaagtctctaactaggtcaacattaatcctctaatatctgcttcttacattaggtaatcagtccatggctctgggcacttctttgggagataatcatctaatgaagtcacaggctggggacaaactgataagcagatggcatgggaagtgtttgcaaggagggctggtcctcagccctccaccctgcctc

SEQ ID NO: 16744 - DNA, 1194 bp, Homo sapiens
tctgtactaaaaaaaacaacaaaaagtaaaaacaaacaacaacctgggtgtggtggcccgcacctgtagtcccaggtacttgggaggctgaggcaggagaattgcttgaacccaggaggcggaggttgcagtgagctgagatcgtgcctctgcactctagcctgggtgatggagtcagactccatctcaaaataaataaataaataaataaaaaagagagagagagacaatttaatgcaacgcaaataacactgacctacctagctgtgcccttggaaaaaccacttaacctctttgatcctcagttttctcacctgtaaagtggaaatgatttccgtatcaagttatcctgaaatttaaatgaaaactacccatgtgaaaacaatatagggcctgacacaaatagatgcaaattattatatttattttctattcttcctttaaaaatgttgttaagggttattacttttaaaggagtttaaggaacttggagttttgttgatttttttttttaattcagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggtaagactttcagtatgatttaaggtaaatcagtgttattgctggtaaaagaaacattataaagacaagcattaatccagatagtagctaaatacagttcacctattagtactagtatttgatagggaaatatttacaggatacccaaaagtagttaatgcaattttaagagttttgtttttgttttgttttgtggcattgatgcctagtgagtcaggtcattccagtcagtaggccagaagtcaatacgtgatcatgataagctctggcatgtgattgtctatgacataaaatccattcaggagcaaagcacccattggcatcagggaattcagtgtctggttataagaagaaagagttttaggatctagttttgcaatgctgatttaaactgcgacatatccataatagtggaaaaggaagacaataggccatagtggtttttacacatagggctcagtgtaaaaagatcctgctctctgttttgctactgtcagctgtgtcgccttggacaagttgt

SEQ ID NO: 16745 - DNA, 1275 bp, Homo sapiens
tctagtcagatgatctatggccaggattagatagtactacagaaagggctgccttggggcaatgggcatggacagtttacagataaagaggactccagatggaacaggcacttgaaaacatgttaattgcattctaaattcttcatttcagttaacattgttacactgagtttgaagtagattaatcatacggaaattttagaaatttctttttacttgaaagaggcattgtctgaatttagttctgtggtctagatatgtttgttagttcgttagtagtgaaaatatgctggcatgtaatagataatccctatttcatccccctccataggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaagtaaggaaaaagcaagacctccaagtctagagtgggcctcacaacttgagagttgtgagtgtgaggttcaatgataaactcacctttctaagttctgttaatggcaaatttcttttgtaaggttctccttatgaagttttcatgactgagacaaaagattgtttaatttatttgtctgccactgattgtttttacattttggatcttttttttggtatttaagagtaatatttggtatttaagagttattgtttcttgaaagttaattatatatggtcaggaagtagagccacattatacattttaaatagagaagaaacatcaaaagaaaacataattatttcaaatatatgaaatggacatttattcttggagcaaatattgttagcctgatatgagcctatgttttcagagtggcagcagtcatttgataaagcaataatttgcgcttaggagatggtcagtaaattgctatagattgacaccagtccctgcacacagctttttactctggagctaaagttaatagcatgtttgcagccagcatcaaaaattaaatgtcacatttataccatttttccccctccttactagcatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagc

SEQ ID NO: 16746 - DNA, 1195 bp, Homo sapiens
tgtcgagtactcactatgtaccaggcgtttgcacacattattccaattgaacatcaggaaatgttttcctcttctataaaatggggctcatgccagtgtaggagccagctccaaatcctgtgcactttccactgcactgcctcctgtggaaggaagtagtactggtgtgtctccctttatgaaaatcaatgtttataaaaaacatttcagctgttccacacacttcaggattggtgctgggtttcctctcactggtctcaaagacttgaaagagaagatagtagctatctgtcactctgggatcaggccctccaggaaccaattacttcaaaaggcacccttatctgggttttttctgggcctttggtgtgggtcagggtaggcttgtacgactttgtaatggaggaaagcacctgcatgggtagcatatcaccattatgcatctgccacaagggaaggggagctctgcccacagctggctcggggtctttggctaaacctactgaaaatgctcatttcagaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgtgagtacctgctgccgtggcagtttgtgaggaaatgataaatttaaaattttaaactgcaacaccacttcaacacagagaaaataaattacccatcaacccagtcctgaacccagctgttgttattgatgtatttatgcatcatttgtccttgaagttgatggtaagttttacctgggacgggtgcagcctcaatggagctctggctggctggggagactgttggtgtgaacagccattatcagcacaaagtagacagcatgttctgccagcaagcctcagtttacacctccactggcagggaggagggggtgttgaagaagccttctctagacggttgttttttaagatggcatcttgctttgtctcccatgctagattgagtggcgcaatctcagctcactgcagcctctgcttcctgggttcaagcgattctcatgcctcagcctcctgagtagctgggactac

SEQ ID NO: 16747 - DNA, 2877 bp, Homo sapiens
catcatggcagttaactaaagattagcaaaaggtcagtgtcttgtcttttgtagaaaactgtggttctccaataaagttatcaattgcctcttaggggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaaattggttgcattattttctgaactataatagggtttttcttcaggtgaacaatttgacgtgtcatcagtttttattgcagcactgtccatattcattgtataaagagaggtctacgtatgtagcatataaaaccacatcactaagtaatagacccacagctttattcttgtgtttacattacccttgaaatgttttcagtcaacccttttcagtgtaagatcagcacatttggtggctgatgctgttctcctttgactgtaccgggagccagattctatcatatgcatgtgtaatcccctgtaatacactcaggtgctcacaaatagagcagattgtcatattgtaacatgcgtgtgccagacaccgggcagtacactttggaaagaatgtgaaatccttttaatttttaatccatagcttactgcttgtgcagtcacctgcctcttgaggttgctcattgcccttggacctgtgaggaggccttcagattagtaattg

SEQ ID NO: 16748 - DNA, 1193 bp, Homo sapiens
caggggcgggtgcccgaggcgcgggtgagtgcccggggggccccggggctcccggagtaactctctattgtaagttcttgcagatacagcgctaggaaaaggggagtaattcaggtctagaatggaaaaactgttttgttgctttgtaagtatctcttgctgcttccggggctctggctcgcagacgagggtgggagcctcggggccctggctgttccttcccaggaagctaacctcaccttggccggatttcttttcccctgtcctcctctaacatcttacctcctgtctcctgaattctccttttccttctctgattttttctcccctctgcctcacttctctccttctctcttctgatgtcttcttccatttacgattccttgttctcatttgatctctctccttctccaatatttccttctttcttgtatgacctcgcctgtctgcttatggtcattattatcatttcttctctcctttctgctgtcttccctgccctgtctggtttcgtgtttttccacccttctgcctgagttctccccaccttgtttctctgacttctctcctctgatttttactcccaccagatctcttctccggccagaggtgacctgcacctgctgatttttgtcctcgactccagcctaaccctcctgcaccctccccggccccagccccagtgcatgtgtaatagcctccccatttttaaccacttcatctccaacagcctcctgcagaccctggtgcatcctcttctcctcttccaagaaatgaaatttgggggtggtgtgttgtggggcaggagggaggaggcagacagcgcaggaggccacttggactcagccatttggacccttcttgggggtatgatggggatgggtacagagaggagagggggctcctgtggatcacaggaggctcaggtgggctcacctcgatttgcgagtgcacccacttagcgtgcacagagctagcgcctgctgtctgccaggccccgtgctggaaatctttccacttccaaagagcaaaagcaaacaggctgtgtgaccttcggtcagtcccctcccctctttgagcctcagtttctctgtctgcagattggggttggataatgagctctcagagggccctttggtttcaagagccattgaagatgctggaaggaagcaagctgaggccctggggaccct

SEQ ID NO: 16749 - DNA, 1242 bp, Homo sapiens
ggggagaattgatatctttacagtagtggatctctgttgaaaacaaaatcccttccctctgggagcttatgttctagtcacacacagaccactcaggggctcttaaaattattgagaaagatgttaatgaccccagtgtaattggtgcttaacacagaaactgtgcttacagagaggaaagaacaagtatgtctagaattgatcagacttagcacatgaatgctaagaccagaccacatgagtgaccactgatgatagcttatataagatgattagagagaggctctctgaggatgtgaagtttgagcaggcacccagtattataaaaactgcccattgttccctaatttaacatataactaaatttaatacaatttgaatgcaaattattgggggaaggtgttcatctgaaagaatagccaaaaaagttttgaaaaggaagaatgaggaggatggttctcccagataacaaaatgttatcttcagtgacagtaattaaaacattgtggtattggtataagaaaaggtagtacagaaaagggaccacaggtctcttgcttaagcagctgtttgtaggccctggacagtttgcagttctctctgagctggctatatctacactgtgtatcttctcaagaaaatatcactaaaatactattgagcaaaactggtgggcatagttaaaggggtggcaaccttggatacgctctgatttttaaaaaatttgcagattttagtactttattattagttattactagatggactattactagatggactattactagatggactagatgctctttgtgatctcttccagcctcatcttctgtgactccgtagtcctctgggagttttatttatcctttaatttaatttaatttaatttaattttttttttttttgagacagagtcttgctctgtcaccccggctggagtgcagtagcatgatcttggctcactgcaacctctgcctcctgggttcaagcaattctcatgcctcaacctccctagtagctgggattacaggtgtgcaccaccacgcccagatacatctctagtatctttactaaagacaagctttcaccatgttggccaggctgttcttgagttcctggcctcaagtgatctgcctgctttggcctcccaaagtgctgggattacctgtatgagccactgtgcccagccttatatatctattaattttattccagcagcagaaactcagcaaagctctc

SEQ ID NO: 16750 - DNA, 2178 bp, Homo sapiens
aggcttatgttaaaaacttaatagatggctcagacttgatctgtttcttagaatgagagaattagttatttctggcttttatataaaatgtttaaatgtctgtaatttagtatcttgttgcgtctctaatattcccaagaggctcaaggagaggaactgtacagctattttctgaatatacctaggcccactctgatcctctgctattatttttccagtgtcactgcaaagataaaagccattgaagcaaaactgaaaatgatggcggaaaatcctgatgcagagtatccagcagcgcctgtttattcctactttaagccaccagataaaaaaaggactactccatattctagaacagcatggaaatctcgaagatgatggttgtgaattactgtagcagcaaaagcaaattggtctccacacctaaaatcgtctgcctgtgtactttgtagatgtgaatggtactattcaacggagcacaatcacatgttagcatttggtaacataatgtttttggatgttcttatggatgtttcttccctaaactatgtatggaattgagcatcatccagaataaatagcgttgtatcccaaattgtgatttgaaccctgggatgctctaattggctggttggtttggatttgtaactccagaaacattctatagtgtgccagagcaaaaggcaaatacacaaaatattatttaaatcaggaaactaaaaatattaacatctattaaaaaattgagcatttttctacgctcgtgtgtcttttacaacataaagaaaaagtaaaaggcagggagggaagtgagagacagattttaaatcatgttcagaactgttgttccagaatttactacggcaatccctccaactggactgaaaaagagaaagttcttggcaaaaaggagctgattctttgaacaaatgttgtagtaatctgtttaagaattatgcttattgtttcaaaatcccaactaggaaaacatggtgtatatcttaaaattgtttgtgttgacaaaactagaatcaaatttaacattttataccacaacacaagttctatttggaaattgaacttttattctatagcaaccatttttttcaaatctaaataaccatgccttctataataacaaatgttgctattatcatgggacttttaaaattacatttattgcatgggattgtttttatagcatgagaatgttctgtttggaattatatcatggtcagtctaaatagaaaaagcaaaatttctttgaaaacctaaacattgctatattggtcactatcaaacatacaattttctaataattgtgtagcggtctaagtggaagagattgcattatcttgtgcaggacgaggagaggacatgcagtgggcacagaaagtcaatggaacagatgccactgtggcaccaagactgtaatgactctgtgtggtaggtagttttaaaggactgcatgccttggaaatgattcttcacttggagaacatacttgcctctagatatgtttgtcactctaagcatcctgaatataacaatagagaaagataagtcaaccaacagatttagggatgtgtttcttcagcacattttggtcattttgatgccaagtttgacatactgtttaattgggcagcacctttgctcctttaccaggtatgtatcactttgttactccaggtgccattcttggtgatgacagaatgtttatcactatcgttgttagcaagaggaagctttcaatataggaacttaacatcttcccatgagtataaatgaatttaagacatttgaatcaaaacttcagtagagggaggttttagaattcataaaactggtttaaggaaattctttttacttttcccaaggttaatctttttaaatatctctagacatcaaatactttctgtatgtattagctgtgtctgtctatgatgcaagtaactctcctcctatttgggggatagttcagagaggtaggagcattatctcccatttttctggtgacttcttggagtatagaattcaccattttatccgtaagtcttcaaaggattatggtggactagaacttacatagtgcaaaatagtcttctatttttaataggaacttagaaaaaacttagaattatatatagagttgtttcctttagaaaccagagctat

SEQ ID NO: 16751 - DNA, 1146 bp, Homo sapiens
tctttatactagcgtcttccttgtatccctttgctggcaagggaatacaaggcgtcaagaccacagatcaaaacaccccacatttgagtggagtcttatttttactccaagagcagttattcccttctagtctaaaattggcagttttttcttttttttaataaaatttttaaaatattcccaaaccagtggaacacagacactggctgcacttagtactgccaaaagccaaggtcatttgcacatattccatcaacctgtcgagaattaggcctcactttataacccaaggcatggaagtgcatgcattctcttagctgggcaaacaattatactgtagttgtgatacaacacatgtggcttttatttgtactgcacatatccactgtacagccacttgggagtatcgtggttagcttgcagcaactgctgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaatatatatgggaataaattctattccatttatttcaatttgaatttccaaattgtaatgtttccctttgtgctataggaataggattaaatgggggaagactaggatttataaggcctgtatatggggggagggcagagatggaacaatgagggttgtgatgatagtgaatagcaaagagtgaattctgtgtgtttttgctgtagcactgaagtgaagagatattagctttggctgttcacaaaatagagcatcatgattttcagtgtttgagagaaaattgatggaaaaagtttgcagtacttgacatgtatttgcatgcacaaaataaaattatttgtccaccttaaaag

SEQ ID NO: 16752 - DNA, 3542 bp, Homo sapiens
tctactaaaaatacaaaatagctgggcgtggtggcacatgcctgtaatcccagctacttgggaggctgaggcaggagaattgcttgaatccaggaggcagaggttgcattgagccgagatcatgccactgcactccagcctgggcgacggagggagactctgtctcaaaaataggaaaacaggacttttctagttacttctgatacttctagtgataaagacatgtctttgctagagactcctaaagtttgctgtagctttcattaaatatgtatagtcacccttaacagtttgcacttaaagctaatttgtttttaatgtcatttcttttttctcagggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgttacttcatgttggggtttagtttttcttgttttttgactgttaggttgataagactatgaactgtgtaatagtagaacagtggctaacatttattcatacttaagaacatgaataatttctgccttgctaaaatgtgactgaaatggttttgacttggcatctgaaagtatacaatgtgttcaacaagtcatgcatcagatttgtgggaggtattgtactgaaacctaaatttcagtcaacatttgaaaagaagagctgggcattccttcctggtgatctttacctatagtttatctatctgtttttcttctgtttctttaagattagtttgacttttattattatttttttaattaacttctgtgaagttgtttactctgaaaattgtactggaatattttaagccaagctgatctttcaccaggtgtactgtatgtaagggcttttcctgctagcaagatgcttaaacaggatcatgttattggtcgtctgagctatttagttgttttacaaaaccacagcattgtatcagataagattttgataaaaagttttgtgcacatttccaggggcgggagggttgacatttccctgaaatttcttgattagaatgagtaaatactggtgtttgatacctgtcttaatgaacatgctcataaggtgactgataagttgtaaatatacctgagaaacaaaggggtagttttgatattctggtgtcagtatggaagatcttacacatttatttaatactcaaatgtatgaagatgtttgtttgtagcataacaacagcacagtagccttgacttagtttcctttggttagtactgtaccttttttgccatggccagtgctccccatccctatgaagacattttatttatttcactctgtaacctgaaatgaataggaacaagggttttaaaccatgttacattaacttttctgacattataaattagcctagaatattacaggaacatgattgttatataatttatatcagaacctttctataaatatgtgcttattacatttgaaatgcttccaatgtactttatttgctgtttgtaattccaaaaaggatatgcaaaccagtctgtctatttcatggatatttaatagtgagatcttccatgttgaaggtaatgtatttttttttaagattttaaaattgctattttgttacaaaatagagacctattaacagtttgagagctccttatgtgccctcagggaaagaaccctctgtgcaacagaactacacaaaacatcttcagcacgttctgagggtgaatatatactacataaattgatcttgtgtatttaaccttatctttttaattttaaaattgaaattttgaaacttggttgtgctctgctggagggggttgggataaactgcttagatgtttgcctacttgtccagtgaaattacatttgcatcagtatatgtatatacctgccaaccttattggtatgtctcagaacatttatattaaaataatgcttgtcttgcagcaggtgatcccataaaacaataactccctgttcttaaaaacttactctctttttcactaacaacataggaattgtttctgtgttgagattattctgtgttgcatccattctctatgtagtggtcaccttctgtctgtcatggtgggcttaatgtgaagtaaagccattggttctctgccactttcgaagaaagggcagttcatctgatccttcttcagaatggtacctactgatatcatcgaggaaaatgttacaaatcagacctaggatatgactttttaaaattgaggcatttcccgtcatttggcctttttaccaacaagatgtgatgtacaaatttggaatcaaaggatacaaagcaacaagagaggaaatgtgtaatgtgggtaaccaaactgcatatgttacctattgtctaatcagaaaaaatagtctgaggtctggaaagcaggaaagt

SEQ ID NO: 16753 - DNA, 1392 bp, Homo sapiens
gagttttttaaattatttttttaaattatataatccttttacagtttggtaacaacagaaaatggcttcagctcttgcataccttttctctttactctgtgttctcaaccaaatttgttgccagttcctgtcatttttacataacatcccttatattctagttatacaaaattttcaaatggtctctttccactccctcaaaaggtttttttgaatacattcttggacaaagtggcatgaggggaaaaaaaaatacatataaactcggcttgctatattaattacatgtatattatatgtgaatggcatatatattttcatgtggcatctgttgcagtagaatttgatatagactgtatttgattatttagctgaagaaactttttgtcaaaactgtttcctcctttttcaatctattcccattgcccattgccattttttgtcttgagtaagatttagtgaaatattcaccaatctgttgattgtttttgaaacaggtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaagtaggtattaggtaaaaatgattactggaaattctttttcctttttagaaatgcctgagtgtttttatttctgctgatgaataccggttaatcagaatttttatgcagaatattttgtgatgtagaagaaacactaaatactaaaaaatttgagttctagtttggttctgcaactgaatagccctgtgaacttggaaagtgggaaagtgactttaactctgagttttgttttcctcaactctcccaaagagactggaccagaattgtttttttttcacaccttattttcttgaactgtagtgttgattccatagaggtgccagaaaagaactaaatagaaacctaagcaggtaaaatgctgagcctctagctctgtttcagtcagagcgctttcactttatactctgtaatgaggtgtagcacttggccgggtgcagtggttcacacctgtaatcccagcacttttggaggctgaggcatgcagatcatgaggtctggagatcgagaccatcctggctgacatggtgaaaccccatctctactaaaaatacaaaaaaaaaattagccgggcatggtggcgggcata

SEQ ID NO: 16754 - DNA, 1100 bp, Homo sapiens
cctggcctcctcacctttctttgctcaggaaactcctgtttattgtgcacaaatcaattcatgtagctttcagctgggagaagccttttctgaaatccctttcttctccctaatttaattccctttcctctttgttgccatcaagccttataacttttactataattttctacttacaagtttctctttcttactagtggctgaaatcattgaaggcaaggattatgtatttagttatgtaagttctgttttgttccagaaagaatttgtggtcaggacattatcttatctttgtaccttatttctgtggtgtctgatatgtaagtatcccccaccctccctgaaaaaggaataaacgaatcagttgaagggagaaagcacagaccaattctgatttttctcttttctattttttaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataaggtttgtgaaattagagatgctgatgttctatcattgctgttacattgaagagtattagaatattctaaagagtctatacacaaacagttggagattcctatgtttttaaatgtcagactcttataaattatccttattttctttttatttttctacttgcaaaataaagggatgcaacagggaaacaaatacatgatactagcataaaagcagtgaggcttacaaagtctcaaatttatctatattctgacctcagagagttaatacagcttataagttttctaagtgtctaatgatgaatttcatagggcagattctgaggtgaaaatttaattcatcactgatactcctactgtggaatctgaagacacttgaaaacgtattaaatatgttgataaattgaaagtatttgagtataaatgtgtcataagaaccaaagtaaaaagcattctcatttctgtttgttagctacagtctccaga

SEQ ID NO: 16755 - DNA, 1100 bp, Homo sapiens; identical to SEQ ID NO: 16754

SEQ ID NO: 16756 - DNA, 1202 bp, Homo sapiens
tgattttcagtgcctcattttgcttcctagccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaagcattcaagattttactataggttggtgcaaaaataatcactatttttgccattattttaacggcttgtccagcctgcaggctacatgtggcccaggacatctttgaatgcggcccaacacaaattcataaacttccttaaaacattgtgagattttttttgtgatttatgtttatgtttttagctcatcagctatcgttagtgttagtgtatcttatgtggccttttttttttttttttttttttttttagacagagtctcactctgtcacccaggctggtgtgcagtggcgtgatctgggctcactgcaacctccacctcctgggttcaagcgatt

SEQ ID NO: 16757 - DNA, 1110 bp, Homo sapiens
tgatttttacatgatccagccaaagagtaccaattctatgcaatagtgagactctaccctgtcaaccaaacagcattttttggtattttctgtcaacatcatttcttcacagggaaatttcaagttggagtgcttcgtttgctcacattcatgtcttgtttttgttactggtttgaagactaaaaggcacgggttcaaataagattggtctctttggttggagactatttctgggttcattcagttgttcaagaaacattagttaagcacctactgttgctagacactatgctagatactgaggataatgaaggtaagattgatatagtccctgccctcatggagcttatagtctcatgtggtcttagtgaaacaaagtctcaatttgcttttatactagaaataataaagaaagctgccttgctgtattcgatcagttaaaatcagcaactttgtgcttttgtatcagtaaaacatttagttctcaccttttgaaaatgcaaaccactgaagtgatttacagtctcctccatttttggctggagaggtgttctgtttctgtgagacatttttctaatttttgtggaacttcactttcctccttctttgcttatacgtgtttgttagattatattgcaaagaagtcaagttactgatatccagtattttacagaggaagatgactttcaaaactagtcatatttctgtagaggaggaagatttttaaaacctttatcattcagcatttgtattttatggatccccaggagaactaaaaaggagatgactctctaccatagtttggtttaaaaaaaaattactctgtcagttatttatttattatttaatactaaactccaaactgaagtggctctgaggtaaatcagatatgattttaatttaagtttctttattagcagatctataaatggaaggtgaccaatgtcactgcttctaaaatactgtcctaaacaacccagaagattttatttcagctcatgaatagctgttctaaatctgttgtatgttagacatactatgaactacctcttcacttattatggggaagtttccttaataaaagtgtgacgattaaagctctggtgtcat

SEQ ID NO: 16758 - DNA, 1139 bp, Homo sapiens
tggggcttgcagtgagccgagatcccgccactgcactccagcctgggcgacagagtgagactccgtctcaaaaaaaaaaaaaaaaaattagagggtagaaaacagaaggctaatacttatatatttttggaggctaagacttgaattgcaacttagcccaaagaaatcactgtaagtagttagggttatcctgaagggaatatgttttatttatttttttgaagtctgaaatatcttggccttgaatagcatgaaattcccttattatctggaataaaaaaaaaccctaagctataagtagtgaaagtcttaggaaaatatttttgaagcatttaaaaaaaaattctgaatatgttgtgtaagaagtacagtgtaattgaatatctggcagacattctatatgagtatctttatggtttttgtttttcaggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaaggtaaaactccctaacctaagattgttttgcttagcttttctaagcccattgcaaaacttggccttaacagaaaacagatatgggaggaaagtgagaacatggaagtaatatacttctttttctttaaagaattttatttgcacttagtgagaagtttgtatttgattaaagattttcactctgattagcttttcctaaatttttcaatacccctaagtgtcaaaactagtggttatagtataaacatttgtcattttagtattgttttcacttttccattgaattacaagtacttgttttgtttggtcctggtttacataatgtaagggcactggcaggtcaaagatgctatttatgaaaatgtgttttaggattattgaaacaactttaaatacctggccatttttttttttataatttctcagccactattacttattttccaatgccctattattgttctactctttattgatataaataaaaacagattatctgttaaagttgtca

SEQ ID NO: 16759 - DNA, 1165 bp, Homo sapiens
acagaaatcatttgcatatctcctggacacaaatctataggttaacatgtaacttcagagtctgagtccttaattaatagtaagtagctaagtcaaaatggcatattcatctagaaaattaagtaatccttgggtggacatgttaaaccaaagttgacagacaggcctgtaggtcaaacctggcctgtcacttgtttttgtaaataaagttctattggaacacagccaaactcactcatttattgcctggctgcttttgcactataacagcagagttgtgtagttgtaatagagacaactggcccatatagcctaaaatgtttactatttggctctttacagaaaagtttactgacttctgtattaaacagtgcttcaagatgatattgaaagagcatgttgccactatcgtggccttacttccatgatagggttaatttattttaagaacccaaatgaacattgcaatgataaaaatctgctctggctgatatttctatagctcatgaacatcttattcccccatctccctttctgtgtttttactttggtatgtgtgtatatatatatttttgtatagccacctttctagttttctctgtaccttttcctatagctctccctttttattcttccctatatttcatgctaccttccttatatggaaggaagaatgttagtatacttacttacatgtaatatggaatgttaatgtacttataatgtgtattgtagtgtaaagttttatattcctggtttaaatttttaatttaggtcagtttaaattatatgtttgcctcaaaataaaactaaaatacaatcagttggagtaatcaacatttttgtggttactgttgatgtgttctctgccattcacctccccctgaccccaccccaactccaagttgtagctttcagttgaagaaaaagttctctacactgttttaagcaaaaggagtggggataaaacactggaacattattagaagtaagaattttcttagtcttgaagtttatgttttagagtaatttaaaacactttttctgtgtagttttatataggaaaccttgaaggatgccttcactaatttgggagatacagaactgttagctctttagttgacactggttaaacattggtagttggatacttgacaatatggtt

SEQ ID NO: 16760 - DNA, 1178 bp, Homo sapiens
ccaagggtactttggcagggggtgctggggaaggggctggcctagggccaggttcatcataccgttagccctgcagccccatgcctgtgtgtcctggtttacccgccgtgtagtggtcctgcaggagtggagcctgtaggacttgcttctcagcggctccaagcagaactctgtctgggaaggtgggaggtgcagccagtctagacctgaagccctcacactaaggactaaggtaggcctgctcagccttagcccttcgtcaggcccaagggtgggggaggcaggaggaggctgagcgtagtcgtggatagaaacctttccctaccgcacggttacacacatggcatgggactcctggctgtagctcactcgggtctactgaagaccaagttggtttttagaaatctatttaaaatatctatcatgtatctatttactgtgtttttctgaatacgcaagtgtaaatagtataatttgcagtgcaaaatccttggcaataactttgtgtattatgtttaaaaacactggaaaccgtgaccaccatggactgcccttcccctctgaggcaattattacatgtaggactctgaactttaaaccttcagcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgccctgacatgttgcattctccccatttggataaataaaaacaaacaaatgcttctgtcacacacagtaatggattgttctgtgcaagacccactgataaaatgaaggatacagctttggtgaaaggttcaagtgcaggctcccttttcctggcccttaaggctctagttcagtacatgttacaggttcttcccttcatgcaaagggatggaggggccgaggatgtttgaaggggggtggatggctcctgataatggacagtgatttgggtggggccagggcctaattcatgatcccgttatggtccttaaaaccctgcctctctgtggtgtgaagtttcctcaacatgaaacatgaacctggcaccctggcacagtga

SEQ ID NO: 16761 - DNA, 1207 bp, Homo sapiens
cctagaaagatgtgaagctacaagggtcacactttcggagcaaattttcttttaggcaaagtgcagagcctggagctacatcctttatatcctctggcacactcgggtgtggtcaaggcttccccatattttgaactgagccgtatgggtaactaggaattggagactaatgcaataataagcttacgcaggtttccttctaaattcaaactctctagttcctttgggtttgggtttggccatttgcttttaactattcagctggcttctgggtctcctgaccatctcatcctctctgtgacttaggtctggtccatttatccaagtacattttggctcactagactcactgtactatgtcttgtataagtgccaaaacatctgccgcttggggcagatatttaaatctgtgtctttcttttagacatacagtaagtttcagattcttcagtaaaggtttgctagagctcgatttttcctttgaaaatactttaatatctagattctaagttacattcatgtttttccttggtctttttttctctcttgttcctccctttcctcctttaacattatactttcaccctgtgccctctgagcccccacatcagaaagctcctctcttccacgtgccatataactgacttccaaagctggtgaaatttgatgcccccatttttcacataaaagatttggtttttaaatgttactgtgatgcaaacctactaaaacgatgctttattttggctgtaaggtaaatatgtcttttggcctttgtaaagctgttgcatgtggggtaatttccctctgatcatctggtgctcttgaatacctgctgttgctgctttgtgatttctccataggttaaatattagcataggaagaggagcagatttcaaatcatgctcgactatgcagaagtctgtgaggccacaagaacgtattaattacaaattcagaaagtaattaatctttccagatttgccatgccaatattggccatagccattaagaagttaagtaaacgcctggccatggctccagctggagctgaggtctgcatggaaagctatgctttgaaccttgacaacccgtttctcctggaatatgtgatatgccacattgagaaccaatatggatttctacagtcgattagaacatgattcaatagcattgcttttgattttcagaattcatggtagctcac

SEQ ID NO: 16762 - DNA, 1105 bp, Homo sapiens
gtgtaaaaaaattgtcatcctcagtttatttttagtatatctcattgatatgagacataattgatttccagttttccttaaagatggttagagattaaaatttcttctgttaaaaaaattgttaatgctattggtcccagatttcccttctttgcatcctgccaaaggaaaaagtgctctgtacttattttgtgccctgtaatgttatagatgcttaataagatcccagattttaagtagcagctgtcattgatttgtttactgaatgaatttttcatgtttcattgtatttgtgcacagaactactctgatgactgtttacttaaataataatcatagtgcacataatttttttaaaaagcaacacagccaaatgaggaaattttctgggagtcttattagttcactcaaatgctgttattctttttattttttattgtttgataatttgataggaatcgcttggtcaaattgtatttgtctctctttatcccattttactgttagaaaatgtttcgatgaaagatcctccggacttattggacaggcagaaatgcctgaacgccttggcgtctcttcgacatgccaaatggtttcaggttggctttttcttactatcttattgttattaaagtttgtccaagtttcatttggaacacctgccacttaattggtttctgtgtactacataaaatgaggggtgctttctagctcatagtgtggttgttggagtaattgagttaatttagatatgtgcctagtatagcttctatagttcatgatgttttattataattctttttggcttagtattctgaatttcagatggttgcttataaaatcaaacatgactgagaaaagctaaaggttaaattaggtagttgcctggagtggggttgccatgagactacgaaattaattttaatattatggtccttttatttttaaaatgtacctttttaagccttaattttactacttgtgattaattgatttttttgtttgcctgataactgatgaataatttgctacttagtattcacttgaaagaacttgcccaaaatgaagaatagatctcaatagggatatctggaatcattttgtt

SEQ ID NO: 16763 - DNA, 1138 bp, Homo sapiens
ggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcg

SEQ ID NO: 16764 - DNA, 1261 bp, Homo sapiens
ccaaggcctggatctcttagatggggcctaaacggagatttagggacttttagtggagaaagagactgggatgggaagccagcaggggagcctggccctggaggaccccctcattataggtggtgacatctcaccagaggaacaggccgaaagttgtggtggtcagagaactacaaaaatagcagccctcatactgcttcctacacaagaggaacgggtggttccagggcagataagaatgactttacaagatgaaaatgatcagtgagggcacacaggtctggagaggagcggagttggcattttttggccctgcaaatagctgcccatctgctctctgtcagaatatgttaggggtgcatctggattgctgcccctgagtctcggctccaggctggtcatgtggttgtctccacgacaactccaggagcggtgtaaacggctgcgcttggagccagatgctgctctgcacatgtggtctaattaaacggtgttccctgtctccctccgccctcccctgcccctcccagcacacacatacattctctcttttccatccctccctgcacccctcctccttacatcctcagtcagcctgtctggctctccaccctgtgtgcctcttcttcagaaatgttcctgttgcctgatttgcagtagaataattcatgcaacaagcatcagagcgcttgctctgacccaggcatggggctagaagctggaggtgcagaggcgagtcagacacggcctgcccctgaggaggtcaccatctagtaaggatctgaccggcagccaggcaatgtaatgcatggcaataaatgctacagcagaggtgagcgtagggctgcagagcccagaggagggacactgacccagccccgggcaaggaggaagcatcccagggcagcttgccctgggttaatcctccaagggtgaagggcaagggggactccccagcctgagtggcctccccacagagggcccagcacacacaaaggcaggagacttacagacctacctggagaaccgtggctggccccgtgttatgggaatgcaggaagtttggggaatgaggagccgcggtgggcggggtgggcagggtcacaccttggggggcttctccccaactccatactctgcttgcttctgcaggcactgaaagccaaggaaatgggagcaactcagtggctgcctgagggggacaaggggccctgagtgaatgaagcctcctgggcatgtttccctcgatgcagtcctgccc

SEQ ID NO: 16765 - DNA, 4122 bp, Homo sapiens
gttacgggtaccagcagagtgatgattttggcccttgatggatctaaaactcggaacattactcctcaatgccgtttccccagttgctctgagaaggaagagacatgttcctcaggaaaagctccagctagcatgtttttcacgtcagtgggaagattcttgtgtgttcgtgtgtatctgtttatttctaagttcacgatacttgttcccctgaattttatttaaccaactagatcacattctttggccacaggtcagactctgagctgctttcctccagatcgggaaggagacacatatcacagatgccttctctaagacagctcctgtgtacagcatcgttctttgctgaggcctctatctgtccaattattatttttgaaattgcttttcaaattaaacattttacccgttgtgttgggtgtcaaaagaaattgctctctgatgaggcaagaacatgtctctccaacaacgtagtattgaacagagcaagttgttaatttgtggagtaggggaaaggttctgcaagttgccattgtacaaatccagttttacaaatgtttgcagcagattccacagaacaaagagcccattcattgccgagagccctgcagaatctcagagcaaagtggctgtgtgttccgagccggagcctgacctgtggaccgtctttaatgtcttctgcaccagtccttttatgacgtgggctttttttaaacagggtaaagtgaatgtgttgcattgcaaactcaggtattatgaggagaaggtaggagtgtagctagcagcgtggagacattaggtcagccactagatgtatttgtgaatttggtttgaaggacacggagaaaggttggaggggaggtttggtgtgtttgttttttgctttcttccccataatgtttggttaacaggtagcctttttgcgagtggaaggagagaaaagttgtgcatgttttctctaatttctctttctgccctctctctgatccccaaccaccaaaagcactcactttgagtgaggatttttttttttttttttttttttttttttgaggcggagtctcgctctgtcgctcaggctggagtgcagtggtgcgatcttggctcactgcaagctccgcctcccgggttcatgccattctcctgcctcagcctcctgagtagctgggactacaggcgcccgccaccacacccggctaactttttttgtatttttagtagaaacattgtttcaccacgttagccaggatggtctccatctcctgacctcgtgatccgcctgcctcggcctcccaaagtgctgggattacaggcgtgagccactgcacccagccgagtgagaatttttatgccataaaaatacgactctgaaagctacatggaaaaggagaatcccacctccttgcactacattgaaacatgcaagcctttccctccctctcctttttgatgttttcttgtcccaagacaaaagtttggcatcttggaacttattcatgctctctggctgcctttgtagacttttggagtcctttgcaaggtttggtggtctcgtcgttaatctggagaaattccccagaatctgtctcaaagcgctcaacctggctcagaggacacccagcccctatgccccactcacaagagaggtgggcaagcccccagggataggaggaagtaagcaggatcctccctgtcctgtttcccagaaccagagcaaggaatggggaatcctaagggtttctgtggcatcactgaatgtcacccactccacatcaacctgcctctcacctgccaccctttttcagggaggtgagtacctgccatggtcactgttaccagatccttaaaatcctgggctctgagctaggtgcattgctctgttacccatttcctacatttgtttgtttgttcttgatttcctgggggaatgggactgatggagacagacaaacccactgtgggcagcatctaagccatgtccaaggttggtcgaattaagggaaccctggcctctcagcaggacagaaagctgagctgtggttccaggccctcctctctgggcccctggtgtgtatcttttttccttgttgcttttgaaatttttgcaattattttaagaatccagtctttcagaccagcccttttattaagctttgaatttttaattgatttttttaaagtaaaaaaaaaaaaaacccaaaaaacaaacaaaatttaacaaaaaaatccgctactcttactcccctgcctccccctaccccagcccatgagagttcccttgcactcccctctgcctttgcaactgatcatcctccctttctccttggcttgaagcatctatgtccagtatctgtgaaatgatgttttatctgtgtgtcaggatgagaaacggcagtcattccaccaagtgttggaaactggttagcctggagacaagggtttctggggccacagctcagggatgtgtatttaattacaggatccccagaaactcctctctaggctgccacagcaacattttttctgggcttgggagccatacctgaactgtttcctccaaggcgggaactccagagagcctgccaagtctggagcaagctggggcttctgctttggccagacctgggccaccatgagacttgaaggcttctagctgtcctacgacacgagccacggtggccctgcctctccccgctcatagaagcctggtccctctgtctagcccagttcccatctagcatccgtcttctgggcctgaagccctaaatggaccacagcctgcacaggaatcaactgtaggctcaaagggaggcggtgagtaaggtcagagcctgctccaagcccaagaacaaaagttgtgttatgggtggaggctagtcccccagatctagccctgccgtctttgccctttaatgaccattgttttctttctctaaaatgtcttgtaataggtgataatgttgttgattcaaatttccatgaaaaagaaaaaaaaaactacctcttaagcgacatcctggtcgattcctctctgaggaatcctgtgggaaaagaatactgtagctcctgctctgtttacatgtttctgtcgggaaagaagccccgcctgccctggggtgttggtgtttttgtctgtgttgccatcccaggtctgccataggggctggtggctgcattgtgatgtctgggctgtgtctggggattccttcccacctacccagccagggactagtcacccccctgaagaggcctccatttccttcctgtgctccagggcatagggagcaccactcccacagacaccacctttaagggctctagtggcacacacatccacgagcctacccccaggttacctgccctaggtccacctccacccacagtcctgtgtgtaggaatcgaggaaacgggatgtccctgagcccttgtctccaaagggccggccaagggctgcccgccagcctgactccatcaaccctccatgaccaaatgatagctggcgggctctgcaggctacccaggccctctgctacctcccaccctgccagctggcaagggatgggccctgttctgtgaattgactacctgtggaaatgtgaccaattagtgtgaaatgcatgtttagcaagtgttaggtactgtatttgaaccaataaatgtgaatccttctgcacatggcatctgtctgtgaagcttgtctggggttctggggagggatgatggcgtgtcctgaggcgccggcttgtgccttcagacctgtgtctcttgctcatagctgacacccacctcaattctgttgctgaggctctggcagaaggtggtgtctcggaactgcctgaatcaatgaaccagcactgactgaagtgcccaacttgtgtgccaggcaccatattgaacttcaaggattattctgttttataagtgaagaaactacagttgagtgaggtgaaaagactctcccaaggtgagtggcacaaccagagaagtgagcctagtggagaggcagatacagacttttgcagtgcaggggggatgaggttgtcattagggatgtatgtggggttgtaagggcctggagaaggagtggcttgttctatggaggatagtcaggaagagctt

SEQ ID NO: 16766 - DNA, 1824 bp, Homo sapiens
ttctcttgccccagtcactcagcaaggtgatactctgcctccaccagcccaaggaggctgacttgcctgtccactagagtgaccactgctaactcttcttctccccccttgttcccaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgtttaatgttacagtgttgtcattgtttagaaatagttcttttgtattttgagggagagggtgggatggggctaagatgactatttccataatgttgacaaagatgactacctcaatggaaatggggggtgtggccatccctactttttccacattttctcagcagactcatacatttgtctgtcagagagcaaattgccttttttagccacagaattgccagataaaacggcacactgtaagggggcaaagtgttgttaggagattcactaagcaaggttggtgagacggcaacagggtaggaggtgaggattgagccacgtcctttccttggaaagcgtgaaaattaagagagtagggcacagtgaccatatttaaggcaggtgtccttccacccaacaagtcctaagggcagaagaatttctgttctcacaccttgctgccccccttacccctgcaccaccatcattgtctaccactgcgaactttccatctaggcaaagtcctggcaatcacttgatccacaggactcgcctcccagctccctcggggcccccagctacctagtttccttacctggatctcctgaggcccaccttcctccttcccactcccttacacatttgacttcctattggccctttgaaaaaccagctgagcagaatgccatgttctgaagcctggtgcccactactgatttattctcctttcaccttgttttcttcaaagggtagtagggcaaggccagactgcaaaaagaatagacactccccttttgaaatctgttcctctcccctccccttcctaccgcaccctcaggtctaaatccgaaaacttcaggcttttttaaacaatgagaaggaccattcacctgtctgctgaccagaaatgttgcccctaagttcttctccaagttctccttttctctccagagtgagaccagttttcctcagggacccaggacacaaagcccaaggcccagagtggctcagctgccccttacttcagcagtggactggccagccaaggcctggagggctggagccagaagcacctggaagggaaggggggctttaaactacctcaggttcctaatggcccggctgctacctctgcagacatggcctggactccttgacctctcactacctgccccaccttatcccaggacgtgttccttaccctcttgactttggccagcgctacaccaggtctgtctttgaactctttcaggtgcttgtcctgcctacacccaggtatctttcacagccagtgtggcaagcagaccacttagttggctgcatgcctgggtaggttggaagggcccacggcacctt

SEQ ID NO: 16767 - DNA, 1305 bp, Homo sapiens
ccctagaatgtgctctatctcaggaatcctctttcgaggatctgtgacgggatctaggtcagggaatgtcccccctgtctctggcaagccaggctccccttggccagccaggtctcatctgacacgttttcttttcctgcccccacaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatacattgcggtgtgtttcgtgtatgtaaaaaaaaatggtaatgaatgggatggtaatgaatgagagttcagttgttgttccggaaacccgatgtggaaggagtagacctgtgtccctgttgagccacccctgggagcgagcatggcaatccacaggccctctgccacaggacgccagcctcggcctcagagctgccggctgctgcagagaggtgtttgctgaataaactatttattgtttcttattcctttgatttgtatgtaattaattttggagcttatttaattaatttaataaagtgccaaacatttaataattgatctaggctttaaaagtcttcagtttgtgggattgcacttggaatcttttgagggtggggcctcagatgtgcctggtcacgtctcctgatgctgggttggctgtgctgcagaatcactgctgcatggacaagctttctttaaagaactaaacgtcagaaatggggagcaatcaatcagcaaatagatggtataatttggttccccataaccaataacagagcttctctgaagggcaaaaatgcttttctttccttttcagcacatgtgactgcagcttgcattctgttaaaggttagggccc

SEQ ID NO: 16768 - DNA, 1181 bp, Homo sapiens
cagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccatccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaactacaatggattttactagtttggtgtgtcagtatttctttgactcattaaatctggtattttgtgtc

SEQ ID NO: 16769 - DNA, 1307 bp, Homo sapiens
tcacttcaggctaggaatttgagaccagcctgggtaacatagtgagacctcatttctacaaagaaatttttaaaattagccaggagtagtgatgtgtgcctatagtcccagctcttcaggaggctaaggtgggagaattgcttgagcccaggggtttgaggctgcagtgagctctgattgtaccactgcatgggccaactgtgcagttccacttaagacacagcctttttttttttttttccaaaaaataaattggaaaaattttggagatttcctacagtttggaaaacagatgaactacatagcctaggaatattgaaaacattgctcacctgggccctgcggccagcagaattggccccgctctatggctgctggggcctgcgcactggaatcgccgtggcctgcgcaccccaccatgccagtttgaacctccatggcctcaaccagattcggaatgtcaaaaagcagagtgtctatttgatgaatttgaggaaatcgggaactttgggccacccaggctctgtagatgagaccacctatgaaagactagcggaggaatcactggactctttagcagagttttttgaagaccttgcagacaagccatacacgtttgaggactatgatgtttcctttgggagtggtgtcttaactggtaaactgggtagagatctagcaacctacgtgatcaacaagcagacaccaaacaagcaaatctggttatcttctccatccagtggactcaagcgttatgactggactgagaaaaactgggtgtactcccacgattgcgtgtccctccatgatgtgctcgctgcagagctcactaaagccttaaaaaccaaactggacttgtcttccttggcctattctggagaagacgcttgatgcccagcccggttttaaggatattaaaagctgtcaggccaagaccccagcttcattatgcagctgaggtctgtttttttgtttttcgttttttgtttttcattcctgcttttgaggaacagctctgtggaaagaacgtgttgcctcctaccttgcccacaagttttgatttttaatttctacagaagatttttttggattaattgtctgatttcctccctcatatgatatcctttatcttttataatgtcttatccctatacctgaatataacaacctttaaaaaagcaaaagaataagaaggaaaaattccagcaggagaaatgaattgtcttcactcttcattctttgaaggacttactgcaagaagtacatgaagagcaactggttaacctgctcactgttctgtctcaaaa

SEQ ID NO: 16770 - DNA, 2666 bp, Homo sapiens
ttagcgtaaagttatcttttcttttttcctaatcagagttcttgaccctttggttattgagtttaaaacttcaattgaaattcaatagtatttatttttgaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttgacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctccacttggttgcttgactggtgaacaaaagtgaaacctttttttttttgttttgcatttgactctgagctaagtgttccaactctttaaaggcaatgtttattgttacaacctcgatccagtgcccagaactatgcttcatgagatcatcacaactctttaaattgtatatttacagtgtgtagtgatgctgacgaaatacacggtagtaaaccaaaaagaaacatttggaaagtcccctagcatgatgccagacacactagatgcttggggaaggttggttctgc

SEQ ID NO: 16771 - DNA, 1176 bp, Homo sapiens
gactttggttgcagtctctgcagcagcagtgatcacttagtgaagagtgcttagggtagttggccaggatcctgaatatcaaaatcttcagcggcagctcccaccagggcttatctcagaaaactgccgatcgcctgggcctggagctcggcaaggcagtgattgagaaattcagcaactaggagacctgtgtggaaattggcaaaagtgtacgtggaaaggatgtctacatcattcagagtggttgtggcaaaatcaatgacaatttaatggtgcctttgatcatgactaatacctgcaagactgcttcagcgagccagcttactgcagtcatcccatgcttcccttatgcccagcaggataataaagagtcaggtgacaatctcagccaagcttgttgcaaacatgctatctgtggcaggcgcagatcatattatcaccatggacctacatgcttctcaaattcagggcttttttgataacccagtggactatctgtatgcagagccaggtgtcctgaagtggataagggagaatatctctgagcagaagaactgcactattgtttcatctgatgctggtggagctaagagagtgacctccattgcagacaggctgaatgtggactttgccttgattcacaaagaaggccaatgaagtcgaccgcatggtgcttgtgggagatgtgaaggatctggtggccatccttgcggatgacatggttgacacttgtggcacaatctgccatgcagctgacaaacttctctcagctggagtcaccaaagtttatgctatcttgactcacagaatcttctctggtccagctatttctcacatcaacaacgcatgctttaaagcagtagtagtcaccaataacataccccaggaggacaagatgaagcaccattccaaaatacaggtgatcaacatctctatgagccttgcagaagccatcaggaaaattcacaatgaagaatccgtttcttacctattcagtcatgtccctttataatacagtaacttctgaggctttttaagaataaaatccaccccaccccttgttttcccttggtatttgatgacgaattcagcagaagacccagcttgctccagtgtagctttctatatcccacatcaggtatatctgagcttatccgaaatgaagaaagaaggatt

SEQ ID NO: 16772 - DNA, 1587 bp, Homo sapiens
ttctgtgagccttgcagctttaactatagctcagctgttacaagatttcagacttttgaggatgttgtgtgggggtgtttgactgtgactggagaagctcagactactctgcatgtgaatgcttcagggttttctttgttgagaacaaccagcagcaaagccaacccatgtgtgagcagttctccccaaggtctatgctaaattatggcaagagccctgggcaaccccaaacctagtcccggtggctgagcaccctgtaaggcaggagtaggcagttgggcttgagcagccatggggtagggggtggggggtggttgaggggggaggcagcacagcgcagcaaatgtttcttgggaggaagaagcctgatccatcatcatctgcttgactatgtagcttggattctcttttgtacctactcctttgatttggctttaccttcatccatcttgatcctttcctggccaaagatcctcttgggcccaaatgaacactgtaccgtagtcttctggaaagcaaatgtgcttcctgctatgtaatcgctaacattcacattacatgatttgctgtagcttgatcttccttagcctactaccactgtggcagtaggttttaggtggtatcatagtgccttttgattaatttaagtatttaattttcatcttctttctttggatctatttggcttttcaaatgaacagagatttctgttaaaaagaaaaaaaagatttgacgtaggctgggcgcggtggctcacgcctgtaatcccagcaccttgggagaccaaggtgggcagatgacctgaggtcaggagttcaagaccagcctcaccaacatggtgaaaccccgtctctactaaaaatacaaaattagccaggcgtggtggtgtacacctgtaatcccagctactcgggaggctgagacaggagaatcgcttgaatccaggaggcagaggttgcagtgagccgagattgcaccattgtactccagcctgggcaacatgagcgaaactcttgtctcaaaaaaaaaaagattcatgttattgtctcttgtagaggaaactaataaagtgtctgtatctgtgtgatttgaggtctttgagaaaaaaaaaaaaaagtattgcctatcttggtcttgccattttgttacttaactacagtacttgaaaggaaaggggctggccgggtgcggtggctcacacctataatcccagcactttgggaggctgaggcgggtggatcacctgaggtcaggagttcaagaccagcctagccaacacggtgaaatcccatctctactaagaatacaaaaattagccaggcatggtggcgcacacctgtggtcccagctactcaggaggctgaggcaggagaatggcttgaacctgggaggcagaggttgttgcagtgagccaagatcacgccactgcactccagcctaggcgacagagcaagactccatctcaaaaacaaaaaaaaaaggaaagaacatttactttatacattattaccaaatggatgctggagtaggtgctttcactgtgtcatcttatttaaccattaaagaaagacatacgttaataactaa

SEQ ID NO: 16773 - DNA, 1906 bp, Homo sapiens
ggggtgcagtggcatgacttgcaacctctgcctcccgaatagctgggattacaggtgcccaccatcacgcccggctaagttttgtatttttagtagaggcggagtttcgccatgttggccaggctggtcttgaacccctaacctcaggtgatccaccgacctcggcctcccaaagtactgggattattacaggtgtgagccactgtacccagccaatgattagcattctcactaataatagcatctgagctggctcctagagtacaagaaaaaggagttcacagtactttaaaatagataaaattcagttgagttagtaacctaactcattgttagtactagttgctgctccttgtagaccaatatgaaattacttttagctcgataaaaccaaaagtgtcactttatgcttcagactgaaatgcggggatctagatgtgctaatgcttgtcagtaacaactaacaagtttttctgtatgtaacttctaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaac

SEQ ID NO: 16774 - DNA, 1277 bp, Homo sapiens
cctcagcctcccaagtaactggaactacaggcacaccaccacacctggctaatttttttttttttttttaattttcagtagagacagggtttctccacattgcccaggctggtcttgaaatcctgccctcaggtgatcctcctgcctcagcctcccaaagtgctgggattataggcagaagccaccgcctggccagactgtaatttaaataagggttaaactatgtgacaatacacttaattatcttttatccttttaggttacccatgcagttgttactgtaccagcctattttaatgatgcccaacgccaagcaaccaaagacgctggaactattgctggcctaaatgttatgaggatcatcaacgagccgtaagtatgaaattcagggatacggcatatttgccaaatagtggaaatgtgaagtactgacaaaacttttccctttttcaatctaatagtacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggtatgttccttgttttctgctttgctaatgagatctccttagactctgaattcaggacattgcatctagatacttagataacagacatcacagtaaccatgtcttttttctaggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtaggtcatcatcgcagcatctttcttagtgattcagtagcttgatggaagactcattagctattgctttagaa

SEQ ID NO: 16775 - DNA, 1196 bp, Homo sapiens
ttgtaaaatgtgaccatatctggataaagaaattaatgtattttctactcatttttcagagatgcaaaaaagaaactgaggcttgctctttgctctgcggactctgttgccttcccagtgctgacccattcaacaaggaatggtttaccagaccacacagacccagaaggtaaattgctgcaggatcgtttaatttttcctatgtttatgggttgcaccatatgaaattgccagtattcagctgttgaagctgtacagcaattccatatggttcaacttaatatgtttacattagtatcacttaagggcactttgattactgatgatttattaaagtattttctaattgggagtggcaatacagcttagttctaatgatacgtgacaaagcagaattgacgtcccaaatgctgaattagcttatttaagcacatggaaattctcaagaataacagaattcttgtatcttttatttagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacaggtaatataccccacctgttcagcttttaaacctagttgttagctgcaagtgttttcttttttatccttatttcagaaatgaatctaggcttcctacaaagtgcttggctgtattttcctggatgtagatttctgtgttagtctgttctcacgctgctgataaagatatacccgagactagccaatttaccaaagaagaggtttattggacttacagttccatgtggctgggaggcctcacaatcatggcggaaggtgaaaggcacatctcacatggcagcagacaagagaagagaacttgttcagggaaacccccctttttcaaaaccatcagatcttgtgagacttattcactatcacgagaacagcacaggaaagacctgtccccattgattcaattacctcccactgggtccctcccacaacacatgggaattcaagatgagattcgggtggggacacagccaaaccatatctttctgccccttgcttctcccaactcatgttctcacatttcaaaaccaatcatgccttcccaacagttgcccaaagtcttaact

SEQ ID NO: 16776 - DNA, 1259 bp, Homo sapiens
tgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagcccc

SEQ ID NO: 16777 - DNA, 1133 bp, Homo sapiens
ggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacacacttttgcatattgtgttgagtttctgaagtctggagtatgtgatgccgaaaaccatgactctgccatgagcctcctgggtggtggcatttgccagcagttgacgaggaagcaacatctctgaaatgcaccggggcctctttggtgctaagcacgacaggctggccctcttcactcaggggtgacaccaaagtcatcacctccttcagccacaaaatcaacacccttctcttactgtgaaatgcaacactctcagtttacataaacacatgtgtccaggtgaaggaacagtggaaagggaacacagcagccaccgcccaggcccagcacggatcaagactctgcattcagctttccctgagc

SEQ ID NO: 16778 - DNA, 1258 bp, Homo sapiens
tacaatttttctttaaaatatttgcatcattctcaacaaattagttagaagactaaaccattctaaaatgtcacacacaccagcaaaatgtattcacatgtctaaaaaaccacatactaaaatttattgtacttctagtttatatagggaaaactgctatttgagggcatctgatttaaaagtattggattgcagtaagaaacagcattaaagtttatgggagctttccatagaagtgcatgtttgctctgtattagacatggccagaattatcattctcatagcgtcctgtaactacatgaatatatatttaccactagccgacttaactaagccctaattaaggactgagtgttttaataaaatttaaagtatacttatttcacttagtcattcttaaaataattaagatactaatgcgacttactttaattgaagaattacccaatatactacaaaatacatccttctttaacggatatggccatttaaatatagtaatctacacataagaattctaacttgagcctcaagtcaacagtaaataattatgatggaattgataaataatgaggtccctgcttgccctttagttctttggacctgtggtctcttagctagaaaaaacagatttgagctcatgaagcagtggttttgcatttttagaataaaatttatcagttggaagctactattctcaccagtaaggttgccatttctcaacctctcccgacctctacctctcttccctagcacagcctgattctgataaaagagcaaacttttcccagaaattttcacagtctcctttggattgtgatgcaccctatgttttagggaatttagtataataatgattcccatttgctttagatagtaaatgaaatacattttttgtgttcagcctgggcagtgtagcaggaccccatcttctgaaaaaaaaaaataaaaaaaagggccttttgaattttagggcccatttcagaatcattaggcctcttattatagtttgtggttataatgtcagagattcctgactaaattctgaactggttcaggaacgtatggaacatctagctcagccctctcatttgatagatgagggaaattaaactcaggggaggcatgacttgcccaaggccatacaaccaaataacagagcagatatgaagtgaagatacagaatgctgaacctctagtctagtcctctgttttataaattcgagttgtagcagattgatttagtacattcttttgg

SEQ ID NO: 16779 - DNA, 1178 bp, Homo sapiens
aaatcagcggactgcataatgtgcactactcattcccctaatcaccagaggcttggtctggtggctgataacaatgaacatcagtagaagagggagagtacttgtgcttttattctcatttttaattgatcttaaaattcttccatggccctttgccttgggcacaatccagagtcatgaatccttgatatgcggctcaacagagaggcacaggacagcgtagtccctttcccttcaccagtttcctgcctgcctttctattctgggaccactgtacagaccattccagttcagagatggagcaagctctgctcgccttcatgcactgcgcatgcagcctggccccactgtgagctctgtgcaggaggggccccatgacctgcagcctttgaggcttcctactgggtgagcttagggcttcttttgcaactaattatatccatctgtttttaaaaggtgaaaaaaaaatcctgaatttaggtgtcgattgatacattaattaccccatctcagttgcagcagtgtggtcttaatagctgattgctgcaatacccaaatctgtaatatcagaatgtgatgtgcatattttaatttgagaaatagtttaacatttttagatattcatttagatgtggttatgcaggttaaacataacgaatgatcactgcttctttcattgcttccaattaaaccttgcttgttagtttaacctctaggtaatcccatcaaacaattgatgtcaaggaaacagtgcccacagtagcttcggatgagtggccattaattttaattgccttgatattaaagattaagaagtattgggactagcagaataaaaacgatctgatgtcaagcaaatccacttgctaaagcttccccaggctgctggtgatattaaaattttactgtgagaattaaataaacctttattagtgatgactgttgtttgattggtccaggggtatgcataaacagaggattcttacatatctagagatgagaccttcgatggtacagagattcctcaattatgaaactgttaataaagctgtaatctgattttccaggctaggtttcattaatgtattatagcttctctgattgtcaaggtaatattaactacaaagtactgaatccaacagagaattgtttggaagaagagaattctaagatgggcc

SEQ ID NO: 16780 - DNA, 1139 bp, Homo sapiens
ctgtcacacagttggtgtttgtgccctgaatactgaatggctttttccctctttttattaatggccagtgatagtcctaaatgcatttatgtttaaaaaaaaaaatcttcaatcctgcagcctggagtttggatggaatatatttatcacctatcccagagaataaggttcttgattccccagatttgtcttacaattgtctgtaagacaatgaatgatacagaactctcctccaaggttgagatcctttgttagagagcagtttcttacgcctgacttgttttatagcatgaacgatcgcatgatccactggcgaggcaacatccataattttgaatgagggagtaaagcttgcctcggtggccctaagcatcgcttctggtgacacacttagaagtccttaatcgcttgctacctagaggcaataaacacacctatctttatgttccattgcctgtgtgtttacctgaaatatgccctgtgtagcaaaacgccagtttcactcctgtgagaaggtccttggctcatgaattgcacggccttcactcacccctattttgccaaaggtggtagtgccttttgtaggcccaagacgtagcttctttggccaggaaaccccttggctatttatgcttcttgtaaaactctggccatttgcttggtttccgagttctaagaaaggagatccatctctggtcatcatgtggagttcagggttcattctggagggcaagatgatgtctccttcactggtgtgtgcctgatgcccaatgcccagcccagggcctagcatacaggggatgttccatgacactcaatgtttcgttgattctgagaggacctgggtcttagaactggttcacccttttgtatccaccctttccagctacattactttagacagtttatataacattgcagtctgttttctttttttttttgtaattttgaattatattttctcttctgaatttgaggattaaagataatgtacatgaaatacccagtgcctagtaccaagagggcactccagaagtggagctgctataactgccgtaaatattgttattccagggaattgctgcttattataccagaaggcactggtctcattcaccctgcagtgtgacctcacctaa

SEQ ID NO: 16781 - DNA, 1841 bp, Homo sapiens
ggtttccctagtgtcccatggactgactgtgtctctctgtccccacccgcccctgcagtacgagtacagcttccgcacagagcagagcgcagccgccaggctcccgcccagccccaccaggtgtcagcagatcccgcagtcctgaggagccagcggccacctgcggggagaccaccgccgcccagactactgacggcaggggctgctgcccccgcctcctcctgccgcctccgccagccctccctcccacactgccccagcagggctggcccggagactgggcagctaagtgggcgcatcctgtcttcagctggcctcactgacaccccggcctccctggggacattgttcataaccatgactaatctgtgtgtgctgtagtgaccagcggctcctaacgtgtctgtgtgatgaccagttgtcctccaaaaacctcactcaccacggagtcaccctgagggccccgggcagttgccctggccgcccagtgacgcccaccggctccctccgctccctcctgtcacctaccagggcagaccccactaagccgttgagtctcttcctggaagaccctgagggccggcagctttgcctaggactctccagggtcgctgatcctccccggcccagggctgccaggaacaagttcctctctgcaggatctcacagcagccctgagaagacatgggaggaagaagccagtggccctggggtggaccctgccctttggacatcccatggacttgtcacccagtcgcctggaagtcggggagcagcacccctgcccccggtggaggggttgttgctttctggggaggaggacggttgacggccctgcttggatccaccaccaggacgctgtgctcggccatggcgcgcctcccccaagggctcatctgtgcaacaaccacatgccaacaatagctccaggtgcctcagccccgtgccctgacccggggaccacagggacaccctctgagacgtgctggccccaggaggatacaggcacacgggcacccagcccctctcagagccaggcgtgtcttgacggtatctgctgacgggaacaagtcattctgaaaggtccctctgacccaggtcaccaaatttgggccagaactggcacttccgagtgcccactggtgctggcgtcctcaaagtgccgggcgccaagttcagccccaggtgcgtttgcctaggcagtggtggctgccatccctcggggcccaggccctcacccgaagggctgcctcactctgtggtgtcaggcactgggctgtgtcctgattcctcagagtatggggacctgacatctttgggtccccaagagttggctcttggatgtggaggcttgatgctgcggttgggggctgcactacctgcgtccgtggaagcctctgcctcagcggggacggcctcctgctgcaggtcctgggcagcccacagtagtgctagctgaggcccagaggaacgggaggaaagggaggcagcgccggacggcgcagctggccaagaggcgggcggggccagaaatacctcatgcccctgcaccagcccctccgtctccaggccccaggcctctttgtggacccatcttcctcctctgccaccccgatcttcactcggatacctcttgatttctgtggataagggaagcggccacttctccctccctgagacccgaggatgcccctggtgggggtggccttctcaggactcctgggtggcacagcagcaggaccttgtcatgggactgatgctgagcagggagggggctgccaggctggctgccgatgctccgttcacataagccagtgtggttctggggacctgaggagccc

SEQ ID NO: 16782 - DNA, 1257 bp, Homo sapiens
caaagcccaacagcaagggtgactcctggcaggtgggggcagcaggagggcagagggcagagctctggccacttctgcccacttcattagggtttgtgaactttgtccttcacctcttttcgtgccctggttgtgagattgcctctaacaggtaatgccaggggcccttcactccgcccccatgactgggaagaggcctgtggcagcgccgctggaccctaggaggctcagaggcagtggtgtgggagccctgtctgcaaggacgcagaataagcagtgagggcggctgcaggagaggaaggggctcccacagcccccactgatgccgctgcaggcccctgtcgagctggggtcccagccaggtgcccccgcatgccctcctgcagttgctggatggatagggacaccaggaagaggacaaactgcatggactcaagcgagctggagccatcttctccatagcattacggacttagcataagagtaaatgactgtgaacgttgtagtaaacggcagcttaagataagtaagcagagacagtgttaaggacgagttggtgtctgtggtagcttttaggctgctcctaacccaccatttattgccttctgagaggtgggtgaggacaagcatgtgcctgtgtgtgtgtgtgtgtgtgtgtgtatatgtgtgtgtgtgcacgcacatgcgtgtgtataagcccacctgagtggggctcgtgcaggagaactgaggcatgaaactctggctcaaacctaggaattgagagcgtttctgtcttttgggagagtacttttctccacgagccctctggccactgtgggagggaaggacaagggttcccttggaaatgtgaagggtcttggcctcatccctcaggtccccccacagcacttcccactactgcttctgtccctgctggcagcctctgtccctccagaacggctaaccagagcacactgtccccaccgcctcccctttctctctggaaagttgaagtatctccaaaggccttggaaatggcacaaaggtgataaggagcaggtgctttgctgcagtctcccttgcaaatgtataattaaggcctttcttcccaccccaagtccaagaacaaatgccagccacgtcctccgccacttggagagatgagaacccagtggggtcacgtaaaggaattgcaggtcggtgagaggacaagagggactcccatgttctaagcacctgttcctggccaggctctaggccaggctctctaagcac

SEQ ID NO: 16783 - DNA, 1218 bp, Homo sapiens
ggaggcccagtggtggctggggaggcttggccatccatctggggctgctggcatttctgagacccaaacctggggcggggaagtgccatgtgtgcatggtgggtgtggctgtagcactgggagaatgcacatgcttccgcacgctgtgtgtgtctgtccagatgcatgcatgcctgtacgttcctgcccgtgagcatgggcccatgtgtgtgaatacgcctgtgagttgcacgcgtgagggcctttgtgagcccacgtgtatgtggcagcaggtgagtgtgcatcttacgagtgtgtgcgtgcatacgctgtggtcagaagcactcttgtgtgaatatctgtggtgtgtgtctttgcttgcacactttcgtgtatgtccacacagccatgtgcacaaccgtgcgtgcacctgtctgcctgttccccgagtgggcctgccttcctgaaagtgtgtgcagccacatgtacgtgtgtgcatgcctgtgctgtggttgtccgaggcgcacctgtgtgagttcctgtgcaggtgtgccctgcggcccaggatgagggagtgaggcgtgtgtgccggggaagggactcgcagggtacagcaggcaggagaccagggcccagatgaggtagggcctgtgggccacgggagggaaggagatcttatcctgggccactggggagccacggcaggtgtcaacagaggggacaggctcccatcgggcagcaggttgccgaaggggacaaggctgaggcctgggctgcccccgccccttcatcacaggccgggttgtgtcccccacagtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtgaggggcggccggggggcggggctcaggctgatgcccgcacacccactgcctttctggagaccaccccctgctcctgctgggggtagggacatccctccatcctccatctctccgcacatcccatcatacccctaaacccaccatctccccgttgctgcccctggagggcctgacctgttcccctctctctgagccaggtccgagagacactggcagctgagacgggcctcagtgtgc

SEQ ID NO: 16784 - DNA, 1204 bp, Homo sapiens
tagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgta

SEQ ID NO: 16785 - DNA, 1285 bp, Homo sapiens
ggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaattcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttataga

SEQ ID NO: 16786 - DNA, 4166 bp, Homo sapiens
gtttttactggcctacaaatctaccttcattccgtactgtagaaacatacataccaggtaactaaatcgaatcactctctatcatgagttagtactcactcgcacttaaggaaagggatttgtagttctgtctacaaaattctccaagcagtgttgtggttttttttgtttttgttttttttctttctcttttcaaacagccagttcaggtgcacagcaactttttctacatgcagttcccagggaaactgcagaacttagaatttgtactttttgtaaagctatactctatgggaattgcaagcaatatatctatcttagtattgtgtgtgctaatgagagcctcagtggctcccccactctctcagtgtttcctgcttaaagaaccaacagtttaaaagccctctaagatactctgtgtgtcaccaaatctgtgtgtcaccattttttggtcatgtggtgctatttttgttaagtgtctttttaggtcagtatagttgtagaaaatgtgaaatctgatggtaataatgaattataattgttttcctctcttgagttcatagcttgaaaagagacctcaaaagcatgtgctggcaaacacgttactgtatgaaaacatacctgagtccatttgaataatgttttattagtactttcggaaatgtcttcagttctgtattgtgttcacatacacaaacaggctttacaagattgcttcggtactgtaaactctggcagagagtaattttgtaggcagtttggtggtgagtttgtgctgcaggctgcctgtgggatgtcagcgttctggtatctgcctgagaacctgggctctgagacgcacaaccagtgcacctccataggagaacagtgcagccacctaaaagaaaaacgaacgaaggaccagcctcagaggctagaagttaaaggaatacagaattagatgtttgctggttttctgtgcttttttggctcctaaaataccaatggtggatttgtttttgtttttgttttttgttttgagaaataaaaagtcattcaagccctttgtgtgtaatagcccccaggggtggcagctgtgcagtcgcatctctttggcacacaggatctgttcacgtgtgaactgctgcgctacacatcagtgttaactccctacagattacactctaatcccgctgctcccgaggagcggctttgctaaatcgggtatatagtatatgcctttttcctcgtcaaactgcctaagtaggggttcgttctctccctgaagcacttgttcaactcctgttaaagccgcgtgcctcaaggggaggctggaccccaagtgtttacccacttaaatatgttctggggtttcaggtaaatgtttgtgggtttttttttccttacatgaataagtttggttttgatttttttttaattgaatgcaaaaaatttgtgttgtgatacaaattaagtttgtgacaagaaatgcccaaatccaaggacataagaggtcaagctcagggaaggaacctccttttcactcaggcttggggcctccagcgaggtttccagagcattccatggtatgagagacagtgaggagggagggcacctggcgcgggcacttccagcgtcctggctcttggcattgtccgtcttaaccttatttacatggagttctttgtatttgtgaatctgtttaactggtttgagtttaccaaagagtgacttatccaaaattgtctttgacaaaaatatccattgctttgattgtacagttcaggttcaaacattgtaatgggactgttaaggggcagaaaattgattgagtttctctctaagaatcatgattccacattttgcaagttccacttgctcccattcgtgttgctaacactttaccctttccactgctcgcagtgttaagaatgaattctcaagccataacacagtactgtaaagttccgcagggcttcgagggaggcagcgcctaggccagcacggagctgtgtagcctctctgagcgttcgcactgtcatgcttcccaggggtgtgactggtgagagattaactccattcagatcgggcagcagcaattaattgtgccttgccgcatgaggatgtgtcaggaggattaacatgaccacagaaccgaaacattctctccctgaagttcacttcacgtctccgcagacgaagtacgctgtgtaactccttagagcaactctttttggaaagcaaagtccctatttctgtacagttttaggttaggtgtttcatttataacagatgcagaaatcaattaagataaagtgatatgtgaagaaatcttttacagtaaaatatatcctgaattcatataggcttgttcataattgagtctcttcttgagctaccttttcaatattagacaatgtgaagacagtgacagcgtccttttctagagatatttagcctgttattacaaactgtgaagacaaagaattttatacttttactaatgtttgtggttttaaacagttattttcattctaatcagttctctaccctctaatttctactaaagctgtaaatacatttagaaattatatttgtaaatacagtatatggagacaagttaattttttggtcagtggaaaaagcctcccaaccaattggccctgccttggcagttgtgttttttgttgttgttgttgttgttttagtttagtttttttttttaaacagcagaaaggatactgtcggttcactgttgagcagaatatactgtagaacgaaaatgataatttttaaatcttccagagcatgagtaaatgtcttttctaatgatagcaaatataaccaactctttgtttttcccttagcccagaccatatagacctgcgtattttgtgtgtggttttgtttttatttttgttcttacagcctagaccctaggaaaaatttgcaggaacacgaaacaagggctggggggaaaatcatctatgtgaatgagctttactttaaagagatcaatgtattttattttatcaactttttctcttagttactgtgatttttgttgttgttgtcctcgttattgttaaattctgtaatggtttcctgtgaagcctccactgaaagggactcaaatatgcaacacctaaactattttccaagggcacatgccccttgaatggtgcttctagactggtcagggttatttattaaattttatatatgaaagtattggggaattatgtaaattctttatatgaaactatctagttcataaatcatagatttcatattactcagtgcaactgaactaaaagttcagaaaagtcattcacattgttccaaatttgtaatggttgtcacatgtcacatgcgtctttttcagtaagtgccagagtgttcccactgtttctgcccagtgcttgacttctcggcccggaagagaacctgctttctctggtttccttcctgagtctggcacagacggggctattgtagttcttgatcaagtcctggagtcagccttgcctggctctccttgtagcagattcagtccacagacctcttgctgcccctcagtgacaagtatgctgtgaattcaacctttggacttgctgcccaagcctttggttgctgccctgactattgtaagaggtaaacttacctggtttgtttgagaatgaccattttcctaatgtgaaaaccatctctctcaccacttttattagtagggctaacatttttttccgttataaatggttgagcaatttgaatgacttaacacagtgtcattatcttgcaatataaactggtaacctcacaactccacacttcatcaccatatgaagtaaatgaagctagctaagcggatgctgtatcaactagtaacttgccattaaggattattttatagcatgaatttaagactatttattcaaatgatattttactcttgtattcactttgttttagatttgtgacatgaatatttcagtgctgcttaattttgttctgaattcttgtttcttgcttgtaaatggcttttttatggtataaataaagtcaatggacattgctgtttgtaaataaaaatgctgctagagcaaatgtgctgtggtctccctctgcgtgggccccctgagcttcggtgagtgtcagtggctctgacaaacatctgcagtgtcata

SEQ ID NO: 16787 - DNA, 1233 bp, Homo sapiens
gaacccagcaatcttcagtttaacaagcccttcaggtgattctgatgcctagtcaagtttgagaaccactactgtagttcctgcactattattctaagaggatcatatgtcagaccccaaattactgtaggtgctttttaagggacccttgagacatgtgcttactgtcatcacttcgaaaacagagaaagaaaagttataaaccataaaaccctaaagtgaatagaggtccctggaaacattctaagaaatttatcaaatgctagtttgtaaggaagcagtgatcatttggagacatcgtatgaaaaataagttgtttctgacaaagtttcttttctcatttattatgcatacagtcacttatgtcatgaatatttattaatcttttccaatgtactatggtcaacactggggattcaatggaaagaaaacagtgtatgatttctcctgcacaggactcaggttctagtggtagaaacagatacgcaagttcaataaaagatttacagagtgtaaatagtgcttcgaggagaataaacaaggttctccgatggagaataacagcaggaaggagggtggctttatatggggagatcaggaaaggccactctggaaattgacacttgagctgaaacctacgtgatgggagagagccagtcatccccggaactgtggaagagttccaggtggaggggtcagtttgggagtgtcctctctcttcctgtatagaaaaccactgttagtgatgagtgtgcatctcaggtgtgttggggacagaaaaatgttcggatgcacagccttagaacttggattttcggatttttaatactctcagatccagctatcctgaatcctggcaatcgccttgacttcctgcctctgacccattggccagtgtgctttaaatatctttgtcccttgtctacccttaattgaccaccaagaatttcttcatctagtggtgggtcaaccaaccttgtagaggtcgattctcttccaacatttgattttgtgtttattatgaaatacttcaggtatacaaaaaaaagtatagggaataacataatgaagacctacaaaaccactactggccgggcatggtggctcacacctgtaatcccagcactttgggaggctgaggcaggtggattgcctgaggtcaggagttcaagaccagtctggccaacatggtgaaaccccatctctactaaaaatacaaaaaaaaattagcca

SEQ ID NO: 16788 - DNA, 1536 bp, Homo sapiens
tcagacggctgaggcaggagaatcactcgaacccaggaggtggaggttgtagcagtgagccaagattgtgccactgcactccagcctgggtaacagtgagactccgtctcaaaaaaaaaaaaaaaagtgccatgtagtccctgtgtggggcaggccccaatcagtgcatgtgggaggaagatgtcagcaataatgacctataatcaggagaccacatacaggtggcaggtactgggcagtttaactccctggcaatttaagcttgtcatttctctaaaacagtttctgccatgtcagatttgtgaaggcttggttttgccctcagccacccgccactgcacctgaccaggtctctgttggctggtgcaatccagtggtgagctgatagtaaaccccagcttaggaaacagggttgttcttcatgtggatgactctgtgccgaaagcatgggaacagcctagaaatgaaatgaaggacacatgatctgctttggcttcagactttaaaagagcttttgctgtttcctcttctgcagttaaacacagtgggaatatcacttttgatgagattgtcaacattgctcgacagatgcggcaccgatccttagccagagaactctctggtaagagcaggacaacatgtaaccgccataactgtagttgtgtttttcactgagtgataacattcttcttacttgaagggtgctcagtgagacccaagatggggtgcagttttctgggactgaaaggatggatcgtaaattggatgtgtttaatctgggcatcaaggacccatggaagctttgcattccgggttatggaactagatggaactctatattctatattaggggagcaggaacctcattccttccattgcctgctatgaaccccttcagtattccccagtatctgcagattgtgagggactgagccagcacctccaatgccaccatttctttacttaaaggaaccattaaagagatcctggggactgcccagtcagtgggctgtaatgttgatggccgccatcctcatgacatcatcgatgacatcaacagtggtgctgtggaatgcccagccgtaagtgacattttcattgttacagtaggggtgaaaggggggccacccagtgtattcacagagataagctgggaagttttggaaatggttactggtggggtgggataatccttttaaactttttactgattttttttttctttcccacagagttaagcacaaaggaaaacatttcaataaaggatcatttgacaactggtggattttctggtgtggcgtcttccttgagggagctagctcctttgtggggtggtcagtggggtcagggtggcagaacctgtggagaagtaacaagcaccttgtggtgggtaacaaaactgccctgtatgggctgggctgagctcagaaaggaagcctttctttcctttttttttttttgagacagagtttcgctcgttgcccaggctggagtgcaatggtgcaatctcggctcaccacaacctctgccttctag

SEQ ID NO: 16789 - DNA, 1536 bp, Homo sapiens; identical to SEQ ID NO: 16788

SEQ ID NO: 16790 - DNA, 1224 bp, Homo sapiens
cccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcgcttctggcctgagtcatcactgggttctcatgggagcccagggaggggaggggacgaggtctggggatggggctcgggcagagggcagctcttctcggggaaggagccaggagtgcgccgcacctcagtcgagaggagaggtcaggtagggccatctcgaatgtcgtgttatcccagcgcccccttcacaggtggagagaccagggcccagaggcagccagggccggtgatggctgcggcctgtgcctccatgagcggaggagccctgtgtgttccgtccattatcccagtgaggcagctgaggctgatgggggtaaatgctcagggccttgcaactgggacatggtgatgcggggtttgaggcccagaagcatcctcaccttcaagcccgtgcggttgtgcaggttggtcactgcacaattcttggagccatatacacttgcactcgctgcagaggtgcacgttgattatgcattttccggcagacggcgttgagccaggtgcagcctcttccttgggctcgtggcaggcctgcttggagcacctgggctctgcctccagctcattcagtgatcgtggccagtgtttgggc

SEQ ID NO: 16791 - DNA, 1882 bp, Homo sapiens
gggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccctagacctgctccccagaggaggggccttgacccacaggacgtgtggtggcgcctggcactcagggacccccagctgccgcagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaagccagttgccttgagtggtgctgttggggtaggggacggggggcctgggctggggactatgtctaggcccccatacggctcggctttcggggcttctcacttgactgagtgcctctatgtttatgatctgagttcttattccattttacagagaaggaaacaggctcagcgagaagggacttgtccaaggtgacctgccttctggtggcagcacaggcagcttcctcagccagacctgtgccgggtgcccctcgggcagccttgggtgatggtgagtccaagagggatggcagcaggcagcagcttcaaggccactcagggccctggggtgcccacagaggggtgggcccaggctcgggctggatccaaacagtgatgccagctccttcaacgctcccgatcacactcctgtttaccaagcgctcactgtgggccaagcgccttgtgtgcaggaacagcagcctcgagagagctctagaaagtggacacagtcgtcaccaccatttcaccgatgtgta

SEQ ID NO: 16792 - DNA, 1768 bp, Homo sapiens
tatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggctccagtctggctttcctttgggcaacggaaggagaaagcttttgcagtggttcatcgcagaggaggcgaccacctccggctgtggcatggagtcttctggacccaggtccccgtt

SEQ ID NO: 16793 - DNA, 1172 bp, Homo sapiens
tctcccaacttggctgtcagtacagaccccagggctgggctctgtactgcgctcactcttgaccactttcccctctttctcacccagttccccattacagccttgcgggagatcaagatccttcagcttctaaaacacgagaatgtggtcaacttgattgagatttgtcgaaccaaaggtaagttatttggttcttacgagaagatgacacttgtagcctaaggttttgtttgtaaacttggaactaggcacacctaaactgcctcttcttaactcagatggacccatggtgactgctttttctggtcctctttcatcgtagctggtgcttcctcggggcctgccctggcccagaagaggcactcagaaaatatttgaccggtgaaggaaggaacagacagatgctctggagggcatgggtgcccgtgggttggagcaggaagaaagaagctggttgtgggaaagtgtgttgggtgtggttttcttgactttttcttctttctattcctgcctcagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaaggtgggggccagagctgggaggaggacccaggcttgggctggtcttggctcccactcccgggtggatgtcactaaaggacccactcttgcccttcctgcagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggtgaggactcccgagcgggccaaggggggtgagggccaggcatctacctggccccttccccccaactgccagggcttcttgagctgccggccctggggcattgagcctcaggaggccctcgggctcaaggggccctcctggtgcgctcttcttcccaggggagcgggactacggcccccccattgacctgtggggtgctgggtgcatcatggcagag

SEQ ID NO: 16794 - DNA, 1208 bp, Homo sapiens
ggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaattttttttttttttaaatttttttttttcctccaggacttgtgtgttttgttctgcgcacacaccgccaactgttcccccacagtcagcagcaggttgggcctgaccattgggacttgattgtcaagtcactggaggtcttgacttttttatctcagttcatgttctcttccataattggaaaggacctttgtctgtttttcctcttgggtgccttccagaacgcatctcatgtccctggtgagggaattggtgagggcctgctgtgagctgctgtggctgcgatggtcacccagctgggcaaatcactggagtgacaatttgacctgt

SEQ ID NO: 16795 - DNA, 1254 bp, Homo sapiens
attggcttccttgacgcgagaggctctgagggtctgaaaagggcatctcaatggcatgggtgggtggggagtcagtcatgtcactgaaattgaatgggggaggcccaatgaggtggctcatgcctgtaatcccagcactttgggaagctgaggcaggaggatcccctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgagaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttataaaaggtgaatctattgaaagaagaacatgaaagaaataaacaggagttcagcggagctagcagaagacaaggcatgtagggggagccattctgtcccagggaagttgtggagggtaggggctgtgtggaggcctctgcagctggtcctcggttttccgcatcggcagaaaactgatggggcacgcagggacaccgcaggctccaggtcctgggtcctgcatctgtcaaaccagattcacacacacacactcacacacgccagcgcgcgcacacatgcactcacacatacacactgatccacacacttgcactcccacacacgcatgcacac

SEQ ID NO: 16796 - DNA, 2070 bp, Homo sapiens
ccccaggaggcatggggatttctcctattgaggtcctatggtaagcgaggggctgaaagggcaaggaccctgccagcgctcaccttgccctgatgacgcccgtctgctctgtcccagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcacctgggtcgagcacagccttctggtccagcgctgcatgcggcctcaggaccacgtcttccggttgggggctcccagtaaagcgatcctcagcttcttcagcagccagtggccagtgaggtgtgtatttttgcatcttgagtggagacctgggggctctggggatggtgggggcgtgcggagccaggcccgtctggcttttcctgtccccacctcaccctgcctgtgtgaccacgggcaagtcacttcgcctctgagagccccaattccttcaagggcaaaaggggaccagacactgccctcaaggagctcaggttccaggaggggaggagccccgtggtacactaggaagaattcccacagaagctgggaaaagagtttgagcagtgaatgcagaaggggtgaggggaaagacatcccaggccacagagccagaggtctctcagctccttaagcgtctggggacctga

SEQ ID NO: 16797 - DNA, 1171 bp, Homo sapiens
ggggttttcctgttcatccttcgaggctgccagtcagtaacctctgggtttcctggtgccccaggctttttggactccaatgacctgtctacctctttcctgccccaaccccatcatcactctgctcacacctcagtcaccctcttgtcaccctggcttctaattcctgcacctctctctctcatggcttcctagggatggggactgtgtctccatcattactgcacatctagaacaggctgtggcactgaggctgtgctcagaaagtcatttggatgagtcagtcaacagccgggtgcctggatgatgggtggatggatgggtgggtgggtgaggtgtaggaggaggtgggtaggtatgtaggtggacagacaagtggttgaccgggtgatcgatagatgggtggatcttgttccccttggaatctgaaacactaaatgcagcatcttgcttgaggcaggcactcagttggtgtttgttgagtgaatgtgagtagacatatgccttgacgaatgactagggagataagcaggttccctggaggatggttgggtaggttcacagccctgtgtgtgggtggctctgctgtgtcatgccctggcctcccagcagccctgagcttagatcttatgtggcctttctggtctgtgtatcccaggactgttcatctcctatgtgatgctgaagaccaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttct

SEQ ID NO: 16798 - DNA, 1247 bp, Homo sapiens
tgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcc

SEQ ID NO: 16799 - DNA, 1185 bp, Homo sapiens
caccaaacccctgtggaggagaggccaggaatgccccttgaagagaaagggaggggcgggactagagcagggagctggagagggaggtcaggctgctatactgcaaccctaggaggcagcctctgcgccacggtttacgggaatggacccccctggagttgtgcagtgcatggcctgggcagctggatgcggcaaccctagagatagggaatggtactgaggtttggagtcaggatgaagcaaattctgggacactgggaaacgtagaattgaacaggatgggtggatgaggtcctggccttgtcctggcctgggtcagctccttaggagaacccaaggctgtggacaaagacggcactgggagagagcaggcagcctcagtgaggccgaggagcaggggagcatccctgggaagaggatctgaactcaataggggtcttgtacggagcaggggcttggtccctcgtacctctggccatacctatggagcccaggggatgcttggcagcacctgggaggtgccaaccccgggtggcaagggagggccggtcccacgctcacattgtcttctgttctctctctctctttatctgtgtcgatgtctctctctcttcccccgtgcccgtgccatcctctccacccctggattcctgtctctgcttggctttcacccacttctcctccccacccacggctgctcctcctcctgtccccacctcctccccgggtgcaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaaggtatgacggccgcctgggcggggctgggcctggccgtccattccttgtggccacagcctcccgtgggcagaaggatctgctgagccggcctcacggctacccgcagggacccagccctagtgtttcctgccagtttctaaccctgggtacttgcactcatgacccctccaggcccccatcccagaagacttgactccaacccaagcctccttggtggcacctatgctagtgatgaagatgatgttaaggagatggcagctgtttactgagcacctactatgtgccaagcacacgctaagtgcttgcccttact

SEQ ID NO: 16800 - DNA, 1106 bp, Homo sapiens
gggaggatgatgcaggagaatggcatgaacccggaaggcggagcttgcagtgagccgagatggcatcactgtactccaggctgggcgacagagcgagactccgtctcaaaaaaaaaaaaaaaagttgttttaaattgaaaaaaggatgagcacaccagcctcacagtgtgtgtggcagtgtcccacggggcatctgggcctgtctcatttcagtttgtttccacagatatgcatggcattgctgcttgtttgtaggggcttaagggaagacagcttgaataaatatagctcctgccctccaggtgcttagagtcgggtgtatatgtgagtgtaggagagaggcagggagcaagagggcagcaccagggaagagcctggtgatggaagccggggaggcttcttggaggaggtcacccaaggcaggcagatgtgaggtgcagaagcctgcagggcagcacaagcctgcctggctggatggcagtatcactgatttggggccggggagggtcttcatctcgctgaccctcaggggccatccctctgcctccaggaaacatcgtgggaatcggccagtgcctgctgcatggcatgacggtggtgattcggaagaagttctcagcctcccggttctgggacgattgtatcaagtacaactgcacggtgagcgagagcgggaagggtgagctgtccctttcccctagttaccctcttcccaactacactccggggcatctgtcttatagctgaggtggccagtcattccaaagggctcatttgtggcaaagttcccattgttcagatgggaaggctgagacccggagagggaaaggatggcatggccagcccctggggagagtaggggcttgagggatcaggagaatcctagtgtagtgagggcagcctctggagcctcgaatcacaccaagttcacccccagattgtgcagtacattggtgaactgtgccgctacctcctgaaccagccaccgcgggaggcagaaaaccagcaccaggttcgcatggcactaggcaatggcctccggcagtccatctggaccaacttttccagccgcttccacataccccaggtggctgagttctacgggg

SEQ ID NO: 16801 - DNA, 1546 bp, Homo sapiens
gaccattctttgcaaactgtaaagggctgtgcctcctcccccacttccctcccctgtttgtcctccagccctgctccctgccttcctcagtactggtggttgggaagctgggagctcgggcccctgccctgcactgagtcttcttccctgctctcccaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctcctagcctgtgtgcaaaccacccaagcccaccctgaccccagaaccccacagccccactgtggccgcttgatcccccacgccaaccccctggcccattgacccgcctcatctgttcattcacttatctaagctgagggtgtagcaggtaagatgccgcagcccctgcctccaatgtgctggttcagccgggggcagtgcccatgtgaatctggcaaggtgtttaacagtgtgggcttgaaagtccaaaccagctctgtcactctaagtgtgtggccttggggaaatgactcagtttcatctgtgaaatgggattcatcagttaagaggattcagaagctaaaagtgctatcacgagtaaggagcttgaggggaaaccgtcacctcgggcaggaccctgactccgcctgaggtgcattttcccagttgtttaggggcgggaaagatttgcaggggtgggggctgcagtgagagccaaagcaaggctgcctggcagcccggac

SEQ ID NO: 16802 - DNA, 1176 bp, Homo sapiens
accagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttactagccttgcttggagcttcatccttggaaacgggtggcacctcatatccccccagccgtggtctgtgatacaacctctccatcctcagcctagggcctcagagctacccttcacccaaaaga

SEQ ID NO: 16803 - DNA, 1149 bp, Homo sapiens
ctgtcatagctcactgcagcttcaaactcctggggtcaagtagtcctcccaccccagcctcctgagcagctaggactacaggcgcacaccatcacacccagctaatttttgtattttttgtagagatagagtctcactatgttgcccatgctggtcttgaactcctaggctccagtgatcattccgtcctgacctcccgaagtgttgggattataggcatgagccactgtgcctggtcttagaatattttcagaaagaaaccccatacccattagaagtcactccacactcgcctccccaaacctcctggcaactcctaagaaagtccctatgtctctatggatttctattttggacactgcacagcgggcccatgctctgtttctcctcgttaggcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggttttttctgacctaaaccagcaggaagtcgtcctgggctgtaagcaccatcacttgctttttttttttttctgatttcacaagtgtggtgttttcccaaggctcccttcccaagctcagtgcaaacctctcactcccaagtttctttgaggccacttgcccccaagcacttcacaatagaccctcgag

SEQ ID NO: 16804 - DNA, 1615 bp, Homo sapiens
tctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttggcctttcttgttttttgcaaaagtgataaaaggtctttagcacttggtctcctcccttgtctctagtgtctttcagaaagttggcaataccttaacaaatgcactctgagctggagggagcccaccatttgcacccacctacccaccctcacccctgttcagatgaatttccagaaagagctaaggctcataaggttcccttttaagtattatttaatagttgaggccagatacttacatgcaagtctgggttatggttgttttgcctttctcagcttgtgaagtcattctaaagctagaggaagtatgtgatatacacatggactaaggctcaggtgacactatggctagattaacatctgggattaggactggaaacacatgtcattttgaactaagggaaactctttgtcatcctaatttggaatttggtccctggatggctagggatccatgaaccaggcaggtaccttttttgtttttgttttgttttgtttcttttctgtttgaattaagatgggctaagatggggcttgcaacattaaacatgagctgagcatccataagcattgaattgggattaaataaagatgttgggcaggaactgaacactgctaatatgatgataaatatgcctgactaaagccactacagaaatccagagattggctgttaaaatttgttttgtggaaagactaattctctttgatactgcagaggcagtggccatggatctgttcctctgtgctaaatgtcttgtggcagggtgtgtttgtgggggagtgttcactggtactcttgagtggcctgaagtgacccattctatgaattgttaattaaggtgccaaaaaaaattaataataaagcttggttttttgaaaaacccattgctgatatattggttcaatatgatcaatttcctctgccttgagctatgtaaatcatgatagtatacaagtccaggtatagagcggtatgcatttattccttttggtcttcttgacctacaccttgggaatattacttctttttctgtcatttccttttttggaattatgtactaataactgaccctattttatctagcaagagatgtgaaagtgtattaaaatctttgaaagacacaataggccgtgcttagtggctcatgcctgcagtcccaacactttgggaggctgaggtgggaggattgtttaagtccaggagttcaagaccagcctgggcaacatagtgagacccccatgtctaaaacaaatttttttggccaggcgcggtggctcacgtcttaccagcctggccaacatggcaaaaccctgtctccactaaaattacaaaaattagctgggcatggt

SEQ ID NO: 16805 - DNA, 1240 bp, Homo sapiens
tgaagtcaatgcagcctggcagcggctgaagggcctggctctgcagaggcaggggaagctctttggggcagcagaagttcagcgctttaacaggtgtcaagccagagtgggctttggggaatgggtctcaacctggaggggagttgtgaagcacagggcatgtgctggtgagctgtcgaggctgactaggccttggtcccatggggtgttcctagttctagggagtcatcattgctgtggattaactggtgcctttgttctgtagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtgggttttacaagcagctgattctgtaaataagttaccaagggtcaggagaatagttctgacggagttcatttctaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggtgcaaataatgctccaggtcttaaccagtatcatttggcttcttttttggaagcaggaatagcagagttaagggtctgttctgtgttctgtgaaagtgtcaggtatcacctacaaatgcaaatcacttcttacctatgttctctctgtttggagactggcaactgtatcatgtgtagtatacgtatggtatttacaacttcataaattcttctattctgcatcactgcattatgattgatagaatgggaatgtccctttaagtatctgagtatcacatgaaatatcttattaaaaccaggattagaaaggaaaagaatccttgctagccaagggttgaacctgggaataacaaggaagttgaaaatgtgggacaggattggggcattatagtgatggagagaacctaagttttaaagggttgatttcagccttctcttgctttccttcacagtctagattgggaaattttcatatttcccagaattagaatttatatagtttgttagacatttgagaacatagaattcagagctttagggaggccattttccaccctggaacctccgctggaaacataatgtcttcctttggtttt

SEQ ID NO: 16806 - DNA, 1128 bp, Homo sapiens
attgcctaggaacattagataaataatgatttatatgatttatatgttttttagtattacatagagtaaagacatttcaaagacttgtcattagtagcttcggagcctaaagtctagggagtttctgaatttattttccatatgttatggagcacccactcagttgacatttcttagtggagagtccctactccatttatactccattaaactccatttatactgcctcacttttaaatggatgccctatttcttctacctgggagtttacttactgtttttacctaaagtcatttgtgatcatttggcaataaattaattctagattaattaaaacaggccatcccttttatattgaacatgcacatacaagtgaatgttgtttttccccttttgcaaatcggaaaaaaggcctgaagattagcactaggattaggaattccaggatagctgttctgtctgcctcggaggcattggggctgacctcatctccctgaccatgtctcctatgcccccaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggtaatctgtgagcaaagccttgccagtggtgggagaagaagggcctgtgttttgcctcctcgggtagtgtgcttgttttgttttaggacatcagtaccatgttagttctgaatccattgaagagggggaattgagcaagcttctctcagctctgccagcatctctccctgctgagattgcaaggccttcagaaaaggccccagcttttcagattagtgtgatgtaaaatgttttattaaagagatttttttcttagaacttagcattgctgggtgcagtggctccctgctgtaatcccagcactttgggaggctgagatgggagtatcccttgagcccaggagctcaaggctgcagcaagctatgatcgtaccaccgcactctagcctgtgcaacagaccgagatcctgtctcacaaaaaaaaaaaaaacaaacaaaaaaaacaaaccttagcattatgtaacatctgaat

SEQ ID NO: 16807 - DNA, 1175 bp, Homo sapiens
ggaaggattccaaacagatttgatgaaagattcatatgcagagtactcctgtgggtgcttaaactttcacaaggatgacatgctatctcgttgaagacataatacaactttatggaaaaatgatttacttaatggaaacctccaaacttctttaagtttgtacccttcattaaaagtaggtcagggttaatattaagaggtactcttcccattgaaaatacatcttagaaataagaatttggaaagctgttaacctgtgtttgacccctgccaggagatcgtgccacaactaatgtctccagtcttgaatggaggtagtgcagtcttatgatatctgactggtgacatcaagcaaaatctcaaaagttatgagaaaaaatgtcatcaccaacctttgggtgaaaaccttgacctatgttaaagtttggtgtgttttatgatctgttcagcagttacttttctccagaggccaagcttgggactagtgtgcttaccaatgaagaactcttatcttccttcctaggcattagatgaatttgcaaccaagctaattcagaacaaccactatgcaatggaagatgtggccactcgccgagatgctgtaagtttgtaggttcttcatgctcctcctttttggtacatgaatgtctcttctaagatgttccagttaagtctcttcaactggatatccctttgggagtgaacactagagactcacaggggatccttgtctttcagctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagtaatgtactgttagtgttgccatgtagcactcgattagtaagctaaacacagctctcacaaataaattgtagctaaaggacgaaataagggattccagaaaccccactacttaatgtaagccaactgttttatacattcctccataaagataagtatgaaggtagtgcaagggaacttgacgttctcaggttcaagatagaaagaacccccttcttttattcacaggatccatccaacctacaaggaaaagtacagaagcatcaggcttttgaggctgag

SEQ ID NO: 16808 - DNA, 1073 bp, Homo sapiens
tacgtggctaaattgcctgttagcactcagtaaaatttctttctaagggtagtccagtctgttccctgaccttgctctgtgaagttaccagtgttttcagcacaggaaaatctgccttaagcatggcagacccgccaggaaaatgaaggtgaactaaccctctaattttcctgctatttctttactgtcatgtcactcatgacttagactgctccttagacctgttgaataactccatagtttcccaacattaagcatccaccatcatggcaccagtcggagctgctgcctttcatccctgtggattaaccccactaattcgtgcatgcttttgctgtgccccctctgtgcaggacacgcataactaaggaggccggcagtgtatctctgcgtatgaagcaggtggaagaactgtgagtaggctgagagtcttgcagagcaccaatgtccactgctaccctatccattctccctctgccgcttctcttgaaggcctttgtccatccagaaagatgaggtggtgggaggaactgcctgtccgtgcagcagctttggctcacaagggaagaggtcgcggtgcagctgtgtcggtcgatgactgcttatctcattggttgcttccatgtgcagctgtgtgttcagagtggtgttggttctccctcctgttggtttttgtggtggaccagccactatcagcagcaaacctgaaggcctgttctatagttttccttagtaggaaggaaatcatatgcttctcttaaagtgctctgattcttggtaactcattgcttttttattttactttgggacacttagatttgatgatgattctagttttttttaatttttagttttttattgtttgttgttttcgtgttcaaagataatatttcagccttttgtattttagttcccgagggttagaatattctttgattcttaagaaatctttcaagtaacagaatggcacagatactcagtactgtgcctgattttccttctgaacttgccaaaactttctgagagctgaatgtatcattttagaaatgtcctactaatatggagataaaaca

SEQ ID NO: 16809 - DNA, 1147 bp, Homo sapiens
ctgatgtttatttgtgacatggggtgggtgctcagtaaatcctgctaagtgaattatttggctttttagagttattggtggtagccacagacaaatatacaaatgtcagctaaataaatttttttaggctgggcgtggtggctcatgcctgtaatcccagcactttgggaggccaaggcaggcagatcacctgaggtcaggagttcaagaccagcctggccaacatggggaaacccacctctactaaaaataaaaaaattagctgggcatggtggtgggcgcctgtaatcctagctacttgggaggttgaggcaggagaatcacttgaacccggtgggggcggaggttgcagtgagctgagattgtgcattgtgctccagcctgggtgacaagaatgaaactccatctcagtaaataaataaataaataaataaataaattttttttagtgtcctgtaatcaaggcagttgtacttggcatttcttaacctgaatgtgtctcgcctttagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtgagaggacccaaagtcatcttctgtctggcatttttgccccagaaagagcagagtcttctgttctgcagagcatacccccttactgcaagctcattcaccactttcttcccataggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccggtacggagccatgttcactcagacttctggaacatagagccttctttgtaggggtcatttttattgtgaaaatagtacatgctcagcagggtacaatggctcacacctataatccaagcactttggggggccaaggcaagcgaattgcttgaactcaggagccggagaccagcctgggctacatggcgaaacc

SEQ ID NO: 16810 - DNA, 2419 bp, Homo sapiens
ggagggtgaaaagatcttaattataagcctactgacttttcctctgagaaattcggacttttaaaaaaataacaagaagttttttaacactttgcccaaagacctagcctcattcagtagatcagattaacccaagataactttctgaggcaagaattatgtcattctctgttttcctgggcagaagatctccttaccaggtaatataatagctatttttctggggtgctggtttccagggacctcatgtcttggatcaatggaatacgggggttggtgtcctcagatgagctagccaaggatgtcaccggagctgaggcattgctggagcgacaccaggtgggtggacctgcctgctgagtagcaaagacgtggctgctctgcagggccctagaggcctcattcccaccctttgtggtgagtcggtggttgacgtcagagtgggcatctgctgccagttacctaatcccttccctccttttggcaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcaggtgtgtgtgctcctggtttctgaccaagtgtttccttgctgaagggcctcattttctcacctgcctcttgccctctttagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggtgaggcctctggaccatggagttggagtctggatttttcctgattgacatctgtttcttggcttatatagtcactgttatatctccaaggaatacctgcgttgtctaagaaaaatatgtacataaataatctttaaaactttatagattctggtatttctgagattttaataatgggggtgccacaggaaaaaaaaatattatcaaagggatggaaaacaaatgtgtgggtaggtaagggaataatgaacaaacaacaaggaagatgtaaaactgtttgatttatacgtcactttgctgtaaatctgacagcattttcctattatcaggcttaattttgttctgttctgatattctaacacctgccccacctgagtgacctggagacttcttgagttaaactctactctagtaatgaatgaaatcaagctttcttttggcattttacactcttgcttctaaagtgtcagtgtattctgatcctgccaccagctagttctcagtcacccaaaataactatccttttctcaagactggcagtccaggcagggcccagccacaggcccaccttgatctcatgcctttgttttctgacaggaagagaagattgctgctctgcaggcctttgccgaccagctcatcgctgccggccattatgccaagggagacatttctagccggcgcaatgaggtcttggacaggtgggtgtcctgtggcactgacatagtcaccagccctgagaggatgcatcccctcatacgaaggcccaggcctgttctgtctccccacttccttctccacggtaagatatgctcatgttggatctcatggtttcactctttcaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggtaagctgaagtgactgggtgttggtcttgatgtagccttatgttattgagtagattttgttaaataaagcatttataaaacaatctccttgcacccatgggaagtcagtgagaaatatttcagtaagcccagccagtgggaaagccctagtcaagtttcagagccatttaaaagttgccttcctcatttgtctccattaaaactatttctgctgtaataaaagtctatagaatcccccttctattactgttcccaaatgctgagcttcctgggggaagtatgacaaaatgagtttctatttaatagctgatatgtgtgtccacatcagtgtactgaactcttgttcttttaatctgtttttgtagctttccaagctgctggtaagtttttaatttttttaagagttgtagttaaatgagctccagtatttgtgttactctgcgtagattattgttattattgtggtcacacggtttgctggtgtctcttcatccatcc

SEQ ID NO: 16811 - DNA, 1160 bp, Homo sapiens
atcacacatgaatcacacatgaatcacacatgattctccagaaatcaagacatgagagtctggaatcacagagtgggtgattcatgatgttccatggacggcctgactgactgtgagggctcaccttttttgtgaatgtttttgtttttgtttttgagacggggtcttgctgtcacccaggctggagtgcagtggcacaatctcggctcactgcaagctctgcctcccaggttcacgccattctcctgcctcagcctcccgagtagctgggactacaggcacccgccaccaagcccagctaattttttgtatttttagtagagacggggtttcaccgtcttagccaggatggtctcgatctcctgatctcgtgatctgcccgcctcggcctcccaaagtgctgggattgcaggcatgagccaccatgcccagcttttgtgactgtttttaagcatatgttaactatcacaatcaaagctggaggagattatggctgattttcttcctgtctcctgtaattaggggtcagcggctggaagagtccttggaatatcagcagtttgtagccaatgtggaagaggaagaagcctggatcaatgagaaaatgaccctggtggccagcgaagattatggcgacactcttgccgccatccaggtgagacagaaaccaaaggtgtcacctgctttctctcttggcaactgcctgctggtcatcatttccctgttggtttgttagagggccctgctcttactaggagagcacacagggccagcagccaaggcctcagtagttggttttagccctcaagatctcacactaggggacatcacccttcagtaaacaaaattggtatggctttgtcagtctcagttcacgggccctgtcattcaccaggcagcgctgtgggcttgagtcttcatatcagtttcctggggctgccataaataagtaccacaaacggagtggcacgaacggagtaccacagacagagtggcacagatggagtggctgaggacaacagagatttattgcttctcagttctggaggccagaagtctgaaatcaagaagcaggcaggaccatgttctgcaaacctgtaggggaggatctttccttgcctcttccagtttttgctggcaccaggcgcccttggcatgtg

SEQ ID NO: 16812 - DNA, 1149 bp, Homo sapiens
actatggctcacacctgtaatcccagcactttgggaagccgaggtgggcaaatcacctgaggtcaggagttcgagaccagcctgaccaacatggtgaaacccccatctctactaaaaataattagctgtgcatggtggtgttcgcctattagtcccagctactcgggaggctgaggcaggagaatctcttgaacccgggaggcggaggttgcagtgagccgagatcacgccactgcattccagcctgggcgacggagtgaaattcactccgtctcaaaaaaaaaaaaaaaaaaaaaaaaaagaattcctaaaagtagaattgtcagtacgtgtatttgtgtgaagcctttgaccgcattgctcttacaaaagccttaccctatcattgtttacccagcagtggacaggggagcaagtggcccattttatagaagtttagagcctttccagggagggcatagtcaggtaaccacagcaggtaaggctgaccagtgtgtgcctctctccatggcctagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgagcactgtcagcaaggcccggaagagccttcccagagctgctctttgtctccttccgtgtcattggttttcttctgcagagaagaaactgatcaattgtgggcatggcagagaacctactaccagggcagaccactgactgccagctaggaggagacagtgtcctgaggccagaactgccacccggaactgggctggcaccagggtcaataaacaaaagcctgtaaacgctgctgcacgcagagatggcataatgtgacgtcatggcatgaacaaagttggcacagcaaaggcaccactagctgccctggtcaggggcgccacccagctcctgggtgagggaaaactgggtccggatatcggggtccacgtgtcctgggtagtagtaatagcaactgaactagaagacgggctgcagggagctcgtcatggcacagatggaggccaggcctgggtgcagggaggggcctg

SEQ ID NO: 16813 - DNA, 1092 bp, Homo sapiens
gaagaagcttctggaggctcagagtcacttccgcaaggtgaggatggggccacgtgaagcttagctggcccacagctcaaggaaggacgcccaccttctgtctgcccagctctgccactcccccttgaggaagctgtgagctcagtgcagagctttcaaacatgggtgtggctggcatcaattaaaaccagggcaaatgagagggccctgtgagatcgccattcagaagcacgcaggacagactagagacaagggcaaagggtaggaaggggaaaaaaggctggtgaagacttgaagggggagcaggagacaggagcagaggggagctaagctcccagcaggctgtgtgcgcctctgattcccaggaaccaccccgcaccccacctcctgcactgcgtcggcacgtccagccctggcgactccgccaactcagtctcttctgcttccaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggtacacctcccgctgccctcaggagctgctcggcctcccagagccctctctgggccctgctcagagcccacacttaactgagtcacgacaagacgagcaggatggaggagcatggtttcatcagaagtttcatttctttttgtgttcttgaggcagggtctctgtcacccaggcttcagtgcagtggtgctaccatggctccctgtagcctcaacctcccaggctcaggtgatcctcttgcctgagcctcttgaataactgggactacaagcacgtgccaccacgcctggctaattattttaatttttgtagacagggtgttgctatgttgcccaggctggtcttc

SEQ ID NO: 16814 - DNA, 1206 bp, Homo sapiens
ggctcctgggctggtgactgagctgagggcccccgtctgagcatctgtgctccccacccctgcagcgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggtacccgggagggctgtgggccaggctcagcccagagcagggggaggaaaagacacagtcacctgctgtgtggagggtctgttccctaatttctgtttttcttccaggaacacaacaggtgtgactgaggaggccctcaaagaattcagcatgatgtttaagtgagttcagccttactcgccctggctgggtggggggtgttcggcagcagggctgcctgctgagccgccctcggctttgtgctgcagacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacaggtaaattaattaaggccaggtgctgtgagcctctgcccggggcacccacctgccctccctgctcaggctcttgcttcccccgctcctagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccaggtatgggcctcaggaggtgggtgaagaggtgtcctttggaaaactaaagccaaatttgtggcagagctgagtctggggtaacaggccctgcgctgggtattctccccatttacaaatcaaactcagtatggacagaagtcccggatctgcttgtagaagcagctccgagcccccagcatcctgagacctgggaggtcgggtttgaagtgggtgcagctggctcaggcaccaggtgccatctcttaccccacagaacctgacccgggaacaagccgactactgcgtctcccacatgaagccctacgtggacgg

SEQ ID NO: 16815 - DNA, 2173 bp, Homo sapiens
ttttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattttttttggactggggtcattctccttgttttatagagaaatgttacttgctattggattcagaaattgttctagttttttgtcttcacatcgttagtgactggggaagcgtgggttagcgctaatggtatgacattggtttagaaagctttgagctggtcggtgtccgagtaaaggacaaattcaaatatcttacttggatacagtttctgagtaaacagtttctgagagggtgagtatagcattttcattctgaagtctcaaaaggacttttcactaggaagaaaattgagtacagtgggtcctgttatctgcagcttcagctacatgtggtcaactacaattcagatactttgagactacattcacacctatactgtatgttaaatgtgtgaatgtatagttatagtatacaatagtcaaaattatcctataccgttaatctcttactgtgcttaatttggaaattaagttttataggcaggtacaggaaaaattgtatggggcttgatactcctgtg

SEQ ID NO: 16816 - DNA, 1188 bp, Homo sapiens
tcctgttccttttacaacagcctgcctgggacccccggcacttggttagacagaacaagctggcactctgacccgcagtgacccttcagaatctccaaggggcagctctcaggtgcccaagtcagtctgcaccagtacagacaggtgcccctccattcagctccttctcaaggaatggccgagtgccggtgtcagaaggggtttaggagtgagcaggactgaaacagtctctgccttctgagagcttccagtgtaagtcaggagacatatactaaacctggaaacagatatgtaattgcaaatactgtagtgctgtgaaggagggaaaaactggtgcttttagagaatcagagggaggccctgttttcctttgggggatcgaggaaagcctttccagggaggaggctcaggatgagatatgaaagaggaggaggcagcaagctgggtggaagagtctgctgggctgaggcacagcacatgagagtgccctgtggccggggaagaaggcgcatggcaggataaagcagggtcctcctttcccttgccaccctgggtgctgctcctcagcccaggctcatcttcagatggccccatgtgacccccgcacagggcaactcagccaggctgcaggaaaaaggaggcactgcctcttgtgctctcaggctagggttggtgcagtgtttacccacgaggtgttctgattgctgtgttcaagtcaagaaccactccgtgacctggggaaataggttctgtttttttgttttctgttttttttttgtttttgtttttgtttttttttgagacagaggctccctctgtcacccaggctggagtgcagtggtgcaatctcggctcactgcaacatccgcttcccgggttcaagcgattctcctgcctcagcctccctagtagctgggattacaggcatgtgccacaacgcctggctgatttttgtatttttaggagagacggggtttcaccagttggccaggctggtcacgaactcctgacctcaagtgatccacccgcttcagcctcgcaaagtgctagcattacaggcatgagacaccatgcctggccaggttctgttttacatgggtagtgatcctttggtgcttctagaagcgtgtttgcaatgtgctaagtataagaagtctgaaaaatgtgcgtgtactgcaatacatatat

SEQ ID NO: 16817 - DNA, 1347 bp, Homo sapiens
tgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccaggaaaggcttccccaggtggctcttcta

SEQ ID NO: 16818 - DNA, 1327 bp, Homo sapiens
ctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcgagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaatgggcattggtgctgtgatgagctgaaactttggagacctcagaacagggaaaaatgaacagggatggagtcagagtctcttagagtagcccttctaagaaaaggtccaggaaatccttctgggaagagcctgttggattcttccagttcagcctcagcagtctgcagctgggggaggagggagtgagtactggctaaggaggttctgcatacatgattacatagcctgttatttttcagatttaaaaaagcttagaccatccattatatgtggaaaaagcatttgacaaaattcaacatcttttccttatttttaatttaattttattttctttgagacggggtcttgctctgtcacccaggctggagtgcagtggcacgatctccactcactgcaacctccgcctcctgggttcaagcgattctccttcctcagcctcccaagtagctggga

SEQ ID NO: 16819 - DNA, 1121 bp, Homo sapiens
gtctggaagctggagcggatgctgaccccaacctggaggtggctgaacccagtgtcctctttgacctgtacgtcaatacctgtcctggccagggtagccgtaccatccgcacggaggtgagcccgcctgcctccccgactgccagccactggggccttgggatctgtccgaggggcgggtgctactcttgccctgtcacccacccttgcccgtggctgccttgtctggaggtggtcctctcatcccccttggcctcttgccacagcgacgagacatgagtgtagctgggagtcaaccatgggtgctagtgcccgtcctgtgctcccagactgggtgacccagggggccctgcccacccctgctccgggcctctggttccttagccgtgcgctcagtgatctcccagggccctggttctgccacttccttgtgtgtgaccacggtgggcacagcagctctccccttggggtctcacttgcatctgtcccacgggggaagccacgtgcagctggagccttcgtcctggcctcatggaacctgtgtacccacttttggggtcaggcataggacgctgtgctacgggaactctgctgggaaggctggtactcccatcagtctcgccgggccgacagccctgtctacccatccctaaggccttgcccaagccgagcactctgagcctgacagccataccccccagcaggaaccctggctgccacccttccaacccctgcacgaggggtgaaaacttcttgcccctcttcttgccctcccctggccctgggaggtgggcgttgttaccttcgcccccattttacagaagaggagcctgaggagcaggctgtgtggtcctccaggtggcaagtgtgcagtgtgaacctgggcctgtcattaacctcaccaggccctactaaggacaggggaccccagtgggccaggtctcgggcagccaggcactgaagacaggctgggagcgggggcacccgctagccccccaggccccagcccactgccacgcttctcttccaggaagccatcctcatctccctggccgccctgcagcctggcctcatccaggcgggtgcccggcacacctgaaagttctaaggggccgaggacat

SEQ ID NO: 16820 - DNA, 1263 bp, Homo sapiens
tccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcaccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaagtggcctttggaggtctttgtgtcatgggaggacgcttccctcacttctctgaagcctgccgggccgtgtggaacgttgcttgggcacctacaggagagttaactctgctcatctcctgccccatgagactctgtgcctttggaggcagttactggagcttgtaagctggacgcagcacctgctaggtaacaggctgtgacctgggctggggatcccatagccagcacaatctctgtcatcctactcacctgtggttgggcactcatgagggggtttttttgttgttgttgtttttttgacagggtctcattctgtcacctagagtgcactgctggaatatagtggcgtgatcacggctcactgcagccttgacctctccaggctcaggtgatctcacctcggcctcccaagtagctaggaccacaggggcatgctggctaattttttttttttttttttttttttg

SEQ ID NO: 16821 - DNA, 1163 bp, Homo sapiens
gctgcatgtacctcctgctgttggagtattataaattctaggccttctcggtggacagagctattacagataatatattaatatatgtatgtatgccacagacctggttttaaattttagcaactgtttatgagctgtgggatttttggtaagttatttaccctaagtgctggcaattccatttgtaaaaggagaatagtaatatttgccttttagggcagtagtaaggatcaaaaataatgtaacttaatgtgtttacaaataacattgttataactgtaatttaaccactttttttttgttttgttttgttaggcataaccagttctgcgttatgaagtttgtagaggtgaatgggtgtgtgtgtgtgtgtgtgtgtgtgtgtgcgtgtgtgtgtttgtgtgtgtgtttataggcatctgaagggcagaaaatagtctgtaggaaaaatattttaaaatatttttattttaaactcagtgggctattgagaatgaagaaatgattcactgttctttttgtagtccaagttcagctgaaaaagtgaaagctaataaagatgtagcttcaccattgaaggaactgggtttaagaatcagcaagtttttggtgagtaaaaattagcactcgctcaatttattacttgcagtgtggatgtgcgtggttatattgctagtgatagtgaaaattcagtttctttttgttttggggattaaattgttttataaatacccaggttgcaactcttctccctaaaagttacaagtcaaagttgcctgatccattcactgcatatcatagggttttcttcaccagacatgtggtggtctttaaggtgactaagtttgtcattttggaagctcacatcatgcctactgctgtattaatgtgcttagtgaataagcatcgttgtttctggcatgtacatttaattgtaataaaaattgtatgtcagtgactggctcttgtcttctattagagtcagaattgttatgttttatgaatctttgagaagcatttttgtttattcaagtcctgtgttcattgtagaagacaaatctttaaattctctgcatcctgtgtgcgatttctgagctgttccttacttaaaatctctgtgtttcagggtcttgatgaagaacagagtgtgcagttactccagt

SEQ ID NO: 16822 - DNA, 1195 bp, Homo sapiens
tcatagaatcttgggctattagaggtgataaggatttggtagagtttcttttttttttgagatggagtttcgctctgtctcccaggctggagtgcaatggcgtgatcttggctcactggaagctctgtctcccgggttcacgccattctcctgcctcagcctcccaagtagctgggactataggcgcctgccaccacgcccggctaattttttgtgtttttagtagagacaggatttcaccgtgttagccaggatggtctcaatctcctgacctcgtgatccccccgcctcagcctcccaaagtacttggattacaggcgtgagccaccgcacccggccaggatttggtagaatttctagcctgcccagcccctcattttacataagaggattgaggccagaggagaaggggagggatttgagcacaggtttgggtacatttgggtaaaaagtaaggtggaaagtatatgtagaaacaaatgtgcaattataatcttgaaggatgaagtgaaggtatctatctttttttattacttgagttttgcctaaaagatggcctcttaactgctctgtttttcttttcagacagtactgcaagatgagaggcagagccaggccttaatcctgaaggtcagtagtagtcaccatttctattctttgatgtaaaattgagtgacagcttcttgacctcattttcctgagcattgctggcttttgactctttgttgggtaagcatggaggtctttatgaagaagcatattaactcatttatgaaaagatgcttttatccactggacccagtagagaagtttctcccaaggagattcttcagctactggtggtgagaacaagttcatggatattttttctttaggtgtaagtccaacaggattaatttgtatttctttatttctttattcttcagtccctttccagcaaccttctcacttaggatctcgtgttaaaatgtaatttgtgacttctgaagaagtttcctattttatatttagtgagaataagtacattagttacaagcaattaggacctatatcagtggaatttgtttttatgtgtttggcctgcctgttgatagcattgtgtgctacatgaatgctctgagaaatcatgctagaaaacatttttggaaacttgtgtatattgttaaacaattaattcctttcatcctgtatattc

SEQ ID NO: 16823 - DNA, 1199 bp, Homo sapiens
actaattctctttctaatgctgctgcaagtattaaggatctttaaatattaagcacctggaaggttcagttgcttttgtgttcctgccttttgctaactagctgcatcaaaactcattattcttgagaaacagtagattcaggagagaggcgcttgctcaagtcactggattgaatgaaacattccgttctattggacctgctggcacaaagggaaggagtgttaaaaggctaaatttgggagtctgctgtcttatttccctccctcctcttctgtggggcttttgggaatctacagtggaaggaatcttgaagagtttttattgatcaactctataatgcataagtgtgattcatgagaggaaaatgtaattttatctatggaaacctttcatttatacgggaacaactgacttatcagacacatattaggattgagactggtaaaatatgaagtgaccaccaaagggagcttgagagaggagaaaatgactgtgagagggaaaaagttatgatttcaaacatttatttcctttttagacccaagttttgggaaaatttaaccagtccgctgtttggaaccctttctcctccctctgaaacatcagaggtaagctgtggcagagggcaggatggtggctacaagtcccttggaggaaaggctgtgggctgtgagatggggccgtagacaatgatacctcccctaattaaacaacagaatgttcccttcactagaaacgtctttctcagggaagtgccagctttctgtccctttgatgtcttgctttgggaaggaaagtggtttgcgctactgtgtgttggtggctctgtggtcttctccattcagttggagacgttgtggacctgacgcctctgctcttgcaagtcaggacattcacattcaacaggggttgtgctaacttgttctgcaagtgttgggcccctgctctgttccctgtttgatatactgggggagatcagtgatcagagatgtgataattgcctgttctgctatctccacagcccagcatcctggaaacctgtgccctaatcatgaagataatttgcttggagatatactatgtagtaaagtgagtactttcccctcttgagattttaactgaaggttgggggagtgggagttggtggcctaccactgggtgcatggctggaagagccaaggcagaggagagaactggt

SEQ ID NO: 16824 - DNA, 1346 bp, Homo sapiens
actggtggatatcctgagatggagcaggggcagtgtgtggccttttatgaggtattttgtctcactccccaccccgtattcttttttttttttttttttgagacggagtctcactctgtcgcccaggctggagtgcagtggcgcgatctcggctcactgcaacctccacctcccaggttcaagtgattctcgtgcctcaacctccctagtagctgggattacgggtgcgcgctaccatgcctaatttttgtatttttagtagagacagggtttcaccatgttggccaggctggtctcgaactcctgacctcaggtgatccacccgccttggcctcccaaagtgctaggattacaggcatgagccaccacgcctggcccacccagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaaggtgaggggcagaggcagggggagcagcagctgcagtctgcccactcctgctgacagccaggcagggcttccttcagcttagggccacacatttcttctgggacttttgagtttccagtcatggaattcttaccccaagaaagctatttttttccctcatgtgtctctccctcctctcccactggacagatgctgtccctcctagcgccctagtacatctccagccccttcctaggaaggaaaccttggtgtacagtgagagttggcctggtgagcatgacagtgtccctccctgtctattctacagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgagacagtgccctagaaggccatccgtcctttccactgcccgccagctctgtgcctgactctggggataagtagtgatcaagacagatagtcgctgcacttctggagttcacggcctggtgggaaaggttaatagatcagacactgcagaaaagcagaagcagcccattgtactgcaggagagaagtgcagggagaacttagtctcacttctgacttgaactgggacttaggtgccttttcagcaatgacttagagattgtagccgcgggcaaatgcaggatccgaagtgaaataggaaatgatgtaaggcttt

SEQ ID NO: 16825 - DNA, 1162 bp, Homo sapiens
actgggagaagggaagtgggtggtctgggggcttgatggggcctcagcaccctgccctctgtgtcccttggttatttctagtttaacagatacctcctaatttcaaaagagtagtcttcacctgaacctctctctctcatgagagtcgtgaagtatttggtcatctagcccagctaccccttagaggaagtatgtaggggccagagcagggcagtgacatgtccaggttcgcatagctcgtcagtggcagacctgagtctggaaccctgggtcttgtgtctcagcctggtgctctttccttgaatctgctggtgttggcccctttctggccctggtggccagacagtggctgtgtctattctgggagatcttttcctttcagcgcagctgggctgccttagttgctgtactacaaggaggtcctgcctctcagcagggttcctgagcttgtctgctgtttgtatcttagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacaggtgaggggctgcctgcattgcaggggtgggagtttcagggtaaaaaaggtactgggccattcatggggcaggtgggtgtggagcctgggcctcagtagcggagggttgtcgatgccttcatttttgagatgctctaagtactctgctggctcactggccagctagtctgctgaaggacgggaacggtctcgggtcagaatcctggttgtaccactaagccatttctttgccaactcagcatttgggggcctgggacgttgcctctccacaggagggtaggtgtgggtatgtcaggtccctcagccatccccatctttccctgatgtgtgctttcctcccagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtgggggcccaagatggtgtcttggagtctggggtaatgcttggagacagggagg

SEQ ID NO: 16826 - DNA, 2605 bp, Homo sapiens
aaaggaccggctggggctctggtggtggacaaggggacttcaggtaacctggggggcatcatggtgggcagtggctgggccaggcctgacaccagccctgctcccccagcaccagattgtgcagtacctgagggacatgttcgacctggacaatgtgcgctacacgtcactgcccgcgctggcagacgacatcctgcagctgtcccggcgccgcagcgagatattgctggggtacctgggggtgcccgcggccagcagcgcaggcgtgaatggggcgctgccccgagagaatgggcccctgggggagctgcagtagaggcggcacgggctggggggtggcagagagaaggctcctcctcccttccctgggttggtatctgacagctgtggtggctgagggccgttgcccctgactttgccccacccccatcatctgggagtccccaaggcccagaggggacatttccatggagaagaacggttcctgggggaagcagaggccaggaccagtggggcctgtgggagagaaaggctgtgagagagggggttgttgtggagaattgggacaggcagagccaggatgccccaggtgggggaccccaaaacctcccatcgctccagggctgctgacaagggtgctgggagggtggaggtgaaggatggggcctagagccctgtggtgaaggtcacagtgtcctgagctagaagccacctgtggctatatggtctcagcatccagctggcctgtcctgatgccctccccacctcaaccgccttctcagagagtttgcaactccagagaaggagagtggggccaccttagtgggcagcaggcctgggccatccagagatggggcagaggtgggcctcccactcctgtgctctcttctgagcaggaactgggcccttgacagtgtcctttgacattccctcgccctaccaaagatcgtcttttctcctcccacctctgtcaccaccaaagacgggcggaggtggggctgggccctcctgcccccgcccatcccccttccatgagcccagacctccctgggtggtgctaggctctgagctgggggctcagaccagggatcgctcaggcccctgtcacctgtgggcccggggaccacttgggggaggtcagaggatgtatgtggccggaccagcttccccaccttcattaggacaagaaactgcccagcactttgccttcagttcaacgcacaaacgctcctggggcctcatgggggcagagcctcccctgggcctgcagagagtcctgttagcagcgacgtccccccgccgcggggtcctgtcagcccggcagtgtcttctcagtgtcttcacctgagcgagtgtctgtggccccaacgcgttctgctgtggctctgccctttccaggttgagaggcctgcaggagaaacacactcccctcctgggtttccacactcaggaggtcagaggactggctcctgtgaccagggcccctctcccctgaatgggaaaggggtctggggatgggagggcgcaccacagagaggagatgatgctgggtgtggcccatcttctgtgggccccttcccagacaccggatccatgggcactaacccgcctcccaggctgatgcccggaggcagcttcctgggcaggagggttccatgggcactaacccacctcccaggctgatgcctggaggcagcctccagggcaggaaggaccctgtgctccccgccccccatcctgacatcctgttcttttgcacttaccctgtgctgtgaatgtaacagtgggccttggccccgcccactctgatttgcattttcatttgtgtttgtttacacatccatgcactgcctgtagcagtcgattgtcacagcttcgacttttggatggtagagtgtgtgcactgactgtgagtcgaataaacaattgagacgatttccttccactttgccatgttgttggttatgtgcatggctgtttgcttcttggggcagagcagggcacctgctttttggggtgccgtgggtgaaggttccaggaggacaaaggtcaggagaagcctggtgggggctgtgatcctacttggggcaacttgactgcctgacaggatccagccatccctaggcagggagggccccggtggtccgcggggaagggtggggagcggccagtgccacgctcaaggccatggatgcaaggtgggcagcctggctgtggaccctgctcaggcaccatcttagggaagtcgattctcactggccctcagtttccacatctgtaaaatgcaggcactggaccgggccaagatgcagactcacaggcttaaaggttgttaccccccaagctgtgagagccagggggaggggctggaacactgggaacaggtccaagcctgccggatcgttacaagttttcatgggcagctggaaatcacaagttttattttacaggtttttaaaaaagaaactttaaaaaaaaatttcaaatgtatggaaaaattgaaaaaactatataaaaccaacacttctggtcatgtaattaacattttgacttttttttttttttcttgagacagagtctcgatctgtcactcaggctggagtgc

SEQ ID NO: 16827 - DNA, 1173 bp, Homo sapiens
aggcctcgccggggagatcagccctgtctaggtgccattcccagggcaggtgctctgattggcccagttcaggtcaatcgctggctactgggtgtgggcatttgcctacttagttgggactacgggtggggtggggacagctgtaggtcactgaacaccagatgtctccacatctgacccccatcctgttttgcaggaacagacaacgcaagctggggacgaaactgcagtgaccagtgggtgtggctgggtccagcctccagatctggcccgcacgatgccttgcaggatggacaggatgacagacagggacgaagcagagacctctacagacccaagtcaccaagtggagcctttttttttcttattttaattttaatgaacaaggtggaccaaagggctgaaccagcccctcaaccaggaccctggggggcctgctgcctgggggccgtggccagagaccctcgctgtgctgctgccagcccctggctgggcagaaagtgccctcggcatgggcacctgggtgtggggtggaggaggagggctcgcgcctctggtctcggggccaggaattccaggtggcgtgagaagtacacactatttattttttggttttgtcagaggcaggcaggattttggagctggaagaatctgctctccggtggctgccctgtgaacagagggctcccggtcagcttcccaggcccttcgccctatgcccagagggcagactgcctctccctgggccggggtggcctgggtgccaggaggaggggagcataccccacaccctccctgccaccgttgccgttccagaacctcggtcagtgtttccctgtctgggggcagggcccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctg

SEQ ID NO: 16828 - DNA, 1208 bp, Homo sapiens
ctagagaagtaagaggcctgccaggagtgggtcaccaggtggcagcccatggctcaagagtgggggctcctgagggctcttgtggtgaactgatgcccctttttggagagcgtttctggcttatcttttctccttcaaaaaataacccagtctcccctgacacccgcatgtttctagaaccttccaagtctctgtttctttgccagattcagcctctttgcagagtcttccttctgcagcatgggtctggggtacagagccctgttcccctgtaaatgctgcctatgagctggggggctgtgtcgaggggaattatgaactgcttggttaataaatacaaatgtgctggacttgcggtgtcagggggatatgctcaggcacacaggcgtccctctgtggtttctgacgtcatgggaacttcatgctggctgcagaatctttctcttccgtcctggagggtcagactctttggcaagagggaggaccaggaatggagccgtccttgtgcctgcctctttcagctgctgtggcggccaccccttccccacctcctggccaggccaggctggctgctgcttcaggcacccctgcctcccatcggccctctcttccctgcctgcatggcaggcagagggctgtcggatacctgggtttggtcatacccaccttggtcctcttgcaaattgaccctttcctcatctcttctagctctgctggtggcaggtgcagaccacgtgtcctgtgggggggcctgggggagagggggtgggcctggaggggtggggcctagctgctgctgctatttatctgaacccaagtgaatccctgtgctggagaggcgctctgaggctcctggggagtcggtgggaacgacaccagaagctcaggtggagatcttatcttcctgaggctgctggatttggtgggcgataggaatcaggccccctttttttggctgtgggagaaagaggggtgactgcgggtaggtgggcaaggaatgttatattttcctagcaggccttgagggccaaaggggaaccttgtctctggcacttgcatgtgcctgtttgtatgtttgcccctcaggcagatgctatagcttggtccccaagtgtctgcgcgtgcattgtgtgcgtgtgcgtttgtgtgtgtgtgtgtgtgcatgcatgggtgtgactttgctgcaggggaggagggatgagctccca

SEQ ID NO: 16829 - DNA, 2235 bp, Homo sapiens
ccccagtgatcaggagggttctttccacctcaggttcccaacttccctctctgggccaagtgatggcacctggctgcctctcttctcggtttctaccttgtaggtttgggctgccttttctctttctctctctcgtgggtctcgttgtggagtgggtgtctttggatagaaggagtgaggaactgggggaggaaggcctgggggatcccctggcggggctacttcctgggcccgggatggacacctgggagctgctgcggttgttggggtcctggcaggggtgtggtgtggccctcaccactctgctcacctgctccttcctcacagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatggtagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctctgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacagcccttcctggctcccccatccccctatgggctcccagccccttgcaccctcattgctgttcagattaaagcctctgttttgcacctgtcacttgtgtgaggtatgtcttttcatgtcacatgtttaacccatttctgcatgactgacctccatcaggtccccttctctcaggccacagtgtctgagacgagctgtttcaatttgggttgagcctttcctgggtttaaatcctagctgtctgcagtcccagctgcaaggttgtaagttactgaagcccctgagccccagcttcctcaattcacaaaatggggacagtcacagggtgactgccagcagtggacagcagatgtgaagtcctcagctcagggcctggcacatagcatatcccgggtggtcactgcagctgtgcttggtgaagggggcccctctggactccca

SEQ ID NO: 16830 - DNA, 1234 bp, Homo sapiens
cgggtgcgccgcgctccagccgccgcacggcgcgccccaccgcgggcagcccttggagcctctgcagccgggtcctgcgccgctgccgctgccgctgccgccgcccgcgcccgctgcgctctgcccgcgggaccctcgcgccccggccgcctgctccgcgcccccaggggccgcccctccggccgccgccgcttctccgcccgcctccccggcccccgcctcctcccccggcttctaccggggcgcataccctaccccttcggacttcggcttgcactgcagcagccagaccaccgtgctggacctagacactcacgtggtgaccacggtggagaacggctacttgcaccaggactgctgcgcctccgcccactgcccctgctgtggccagggcgctccgggaccgggcctggcgtccgccgccggctgcaagcgcaagtattaccctggccaggaggaggaggaagacgacgaggaggatgcgggcgggctgggggccgagccccccgggggcgccccgttcgccccctgcaagcgcgcccgcttcgaggacttctgcccggactcgtccccggacgcgtccaacatctcaaacttgatctccatctttggctccggcttctcggggctggtgagccgacagccggactcctcggagcagccgccgccgctcaacgggcagctgtgcgccaagcaggcgctcgccagcctcggcgcctggactcgagccattgtcgccttctagggacccccgagggcacagggacccggggccccgcggggctggggccagacaaagactcggcaaaggggcgagaggagggaacgagcgggcgccgggccactcggggctgagctgggggcgagcgggggcaggcggctgatgttttataaattgtaaaataaaaaaaaaagaaatctaaaatcttggactttatttttgcagagagaaaaagcgcctatttaagtatgctttgtgtttctcctactcctttttttctttttattgtagtgattgcagtggtgtttagcgaggagcctaccacgtgagggagggctgctgcccggaggaggtgccgggcagccgggggcgaggcagggcgccctggccgccggggcgcgccgggggcgcagctcaggagggcgccggacctgggaagccgattccaatcagttgtcagacccgggaagcccgacgttccgctctcccgagtccctctgtggggtgaggaat

SEQ ID NO: 16831 - DNA, 1228 bp, Homo sapiens
aggtactctggaggctgacgcaggagaatcgctggaacctgggaggcagaggttgcggtgagccgagatcgcgccactgcactccagcctgcttgacagagcaagattctatctcaaaaaaaaaaaaaaaaaaatttaaattatttttcaaaagaagttaagttaaatccggagcccgcgcgggggaggggcgagctgagcgagggggtggagccagccatgggcccgcccctaaacgcccggaagtgacgttggcggacaaaggcagcgcgcgccgcgagctgtcgcgtctggtcgtggtctggcggagctgcggttggcttgtggcgtctccgccgccgccgccctcccttcctcttccccatcttcttctctcggtcccgggagcccccgcccggagtgagtagcgcgaggcggtgcgaagggtaggcagccgctgggagaggggaggctgcgacccctaactgtttcggcgccctgaggtcccgggtccccggctcgtcacgtgacccggcgcgtgcgcgcgggccggcacaggcctcacgtgcgcgtccccaagaggtctacgggccggacctgggcagggactacggagcagtccatgggtcggggtacaggaggaaagtcaaggcactcaaagcccaggcagggcactcccccaccccggtccccagaccgcagcaaatccctttctctgagcctgtttcccttccgagaaacagggatatggagagcgcccacttggaggatggatgggaggaatcggtaaaatcggtaaaatgcccagttcagagcctggcacagttaagtgcccgctgcacagaagttgctgtcgtatttaaccttgggtgccacccgagcgccagcccgacacaggtgcagctcaaaaaagacagcccgagagcccttgcggccaaggtcagcctgtctgcagggaggctgccatatcgaaaagcccagactttgctgcgcaccaactgtgtgatctctccctctggactttggtttctcctctgtactataagtgattgccacaactggtgtcagaggccctgacagcggggagggacagtgtaaccggtggttgtggtgtgtagaatgattgcccagtgagatgggatgagcctctgggaggaaccagggctggtataaggagcctggattccctccttaattctgttctcggcttcctgtttgtatgtttaaagacacgtcacttcctttagtg

SEQ ID NO: 16832 - DNA, 1223 bp, Homo sapiens
ttacgtgaggaggatgagatgactgcaaaagtctgccggtgacagtttcagcactgttttcttccatgggtcgtgggagaagagatgcagtaccttgggtctgaacaccttggcggggaggaggaggcagcagccaggtgactgtgaaggatgtaggatcacatttactggctgagcagccatttaccaggcatgaggggtttgtcttcctctctgagctagcctagagtgcacacaaagcccgtgtgctcctggccccctcccaggcccttcagccacatacggcatctgtgctctggagcagagtgtagcaggaccacctgctgttggctgactgaccttgctgttccctcagactcttagggacctcctcctgccccactccaatctggacaccacgaggcaaaatgtagccaggaccccaggaatcccgtttattaatgaatcagctgttagggcagatgtcaaagtcaggcttgctatttcccggccaggatgtgcctcccctggcttgttcccagaatttgcgtgtaagtggaattcttgtaaattagattattcaggggaccctgacatttaaaggaatcatgttacaaggcttttggtaaagcacagaattatattgtcggtagcagccttcaggccttcagtatttaccagttctgaatggttggacttttgtctgtaggattttcttagagtggaaaatggctatagctgcacaaagcccattcttgcattatttggcaaccagttagtcaatgcccacctggtatcaggcactgggctaatggtgtacaaggtaatgtctctacccccaggaagctgcatgctgggagaggagacggatggagtccagcctggtatgtgtttgcccccagatttattctgttcatttgatcagaggtgaactttctgttgaatatttgtgtttcatgggatgcaagagaagcatggtgataaatctcaaatgttgccactgctctcaggagctccccggccaggcgagagagagaactgaatacaaaaccttcagtttgccaagttgggcggtgagagggagacaggcttgctctcgccatggtccagtctgaatgggagttgtgccagcatggtgtggaagagtagtagttcgttttttaacctttgtctttaattttcccagccaccaagtgttttttgttttttgagacagggtctcgctctgttgtccaggctggact

SEQ ID NO: 16833 - DNA, 1663 bp, Homo sapiens
ccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgtgggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttggactgccgttactgatttgtaacttgaaaaggctacggttgatcatgaccccgcctcccccacctcccttataagatgtggacgagagctttattgacctactgactataaaatagtaaattctagattttatcatgtgaaatgccacttgctaactttttctagtttatttggttccaaagttcagaatgaatttcagcagcacagctgtgagactcaccatatccgggacaggcgggtg

SEQ ID NO: 16834 - DNA, 1203 bp, Homo sapiens
atggctgcccttgacgaccagcccgcggaggcccagcccccgtcaccacggtcctccagcccctgccggacgccaggtatcagctggccggggactgcgggaggaacctcagcctatggcccagtacctaccgggtgctgagcgccgacctgcagtagcccccgggggacgggttcttcactagacccgaatgacagtggggaagtcagcctccgggggggctcagtgatgtgcccagggtcccctagctcataatgctggagcccaattcagagccctctcccagagccctgagccttccagccggacatggattggacaggtctgctccggcctgtgtgctggggccaggagtgggcacatgacagaggagacacattagggtcaggctttcgtccctttaggaggggctggcaggtcatcttcctgcccactcgtggagctggcctggctgccctggcccagcatggtaccctctctgcccccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaaggttcggggggcacgggagggtgggtcagcttgaggctgggagtacagattacgcccgtagctgcctttctcatggccccctgtggcggagggccgggctatgggctcctctcaggtacacccctgagacaccagtgtgggagccacgttttgcagaggatgacacagaggcatgagatggtgaattgcttacccagtcatgtgactcacggatgtcactccacatcctgtcaaaggaagccgcagggcccgcacctcgccccggccaggcaggtggaggctgggctagtcctgtgctgtgtccccagcccaggtattgagtgctggcagccggaggcggaaggagcagcgctaccgcagcgtcatctcagacatctttgacggctccattctcagccttgtgcagtgtctcacctgtgaccgggtgggtgccccagggatggggggagctgggccaggctgccagtggcctcagcagctcttgccctgactgggtgcagggtgggctctccacgggtgctccctgcttttatccaggggagggccctgcctgcgtggatcccgtgtctatggcc

SEQ ID NO: 16835 - DNA, 1137 bp, Homo sapiens
cccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcagtgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcgatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaatgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtggctccgtgtcacgggactgttttgttgcatgaagatatgaccctagttgtggaagcagcctggtgtcattggaagccccctgggctggggagctggcccctgggaggagctggagacctagatagctctcagttccacccccatccacggtggagggggaggctctcag

SEQ ID NO: 16836 - DNA, 1208 bp, Homo sapiens
cagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcc

SEQ ID NO: 16837 - DNA, 1210 bp, Homo sapiens
actaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgct

SEQ ID NO: 16838 - DNA, 1167 bp, Homo sapiens
cttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaa

SEQ ID NO: 16839 - DNA, 1891 bp, Homo sapiens
ggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtccggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcacgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcttcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctcttttttttttttttttaatatctgcggaataaacccaatggttaa

SEQ ID NO: 16840 - DNA, 1238 bp, Homo sapiens
cagcaaagattgtggaatcctgagctggaaggaccctgggggatcacctggttctgggatgggaaataggtcacaggtgatgggttatgtgtgaagccacttcctcatccagggcccataggagtcatccctctcaaactagctcctcttcgactgaacctggccacagctctgagtccttctctgtgtggctgtgctgttcaggactcttaggtgcaaattttagaaactgaactcaaaccaacttacgcaaaaaggaaagggaaaagacaattcttggctcacacaactgagaactccaggggtaggatggcttcaggcagggctggatccaggtgcttctaagatctatctccaactctacttggcttcattcttggcctctccacagggcaggcaaggctcatggtcaccctcatagcccacctttcccaaaaaggagggcttacccccagtagggcccatggggacccaccacgcattagtccctatggctgcatcatggggtgcgaggcttgggccatgagcctactccttcagtgggcgggatttcttcctctccatccctgtggaatggggtccacccaggaaagaaggttctgtttccagaggaagtgagcctgggtctctggacagacaaaacttagctcttgccaaaagtggcttgtttgccggcatattggcatgtctaactgcgcccaatgcccttgtcattcaggttggggaaagtgaggcccaggggaagaaatactttgctcacagtcacctggtgggtgagagcacagctttgaggggctgcaaagagcccagggtgtatccatctcactgtaggtagcacagcggggcaatcagagctggagctgggcgtatagacccctgggctaccacctgggggatttaaaagctgaatgtgattcagataagcacctgcagctgggctttggcaagattccagggtctggtgagccgaatgaagggagtgagggctgaggccaggatctgggcagcaggccagagtccaggcagcaggaaacatggcagtgtctagacaggggctgtcagaccccgaggtcagggcactggccacagggacggagctggaagttcctgagcacgggcttctctgcctcccgcctctcagctgcctcaggatggccaaggcatggcctttgactagggaggagagctggaggctaggaaggccctgacaagctaatctttgcactggctgagaaaga

SEQ ID NO: 16841 - DNA, 1153 bp, Homo sapiens
tgaagaagaagcgtggagtatgggagttcagacagtgagtactaatccttgcttgctttcttcccatctttctcattgctggctctctctcctgcctgcatttatttaacaaatgtatatattgagtctactctgtgagaagggtcatgttggatgggggaacagagagatgtaaagggatgaaagatggtctctgcctccagagcagctggcatcctaataggagacgacacctttgtggagacacaagcatgagcagagggcaggcttgaaaggggcggcaaggctctgtgtcacagcgttggtactgtggtgtgtgttgcttttaaattccagcccggtagcgtggcggatggcagagagacctccgggttgtgggggcaggagctggagctggatggagggctgccctgactcccgcaggtttttccctcagtgctatttccctgtcttgcacacttagagcctccatttaatgctggttctcttgtggttcttttccctcccaaagacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggtgtgtgagcccggagcacggagcacagcggccgctcgcagcaggtcttcagcttcctggcccaggagatctgcttacggctggcattccctggctgggctggctttgtgcagcattgtgctgaggcttccttcctccatttgacagacagcttctgaacatacaccacggccacgtctgatgccaaatatgatgccaagtactagggcaggtgtgccctatcaggggccccagtgaactttgagcagcctttttggcagtgagctctgtgagggctgcttttatcatcataggacagcatctcagataaaagtgcagtatttggagtcagaggctctgacccagcattcttcctcactgattgatcttaaatgtgctcatttactttttgaaggttcagggtctttgtgtgtcaaaaggggcaagtgcaggcttcactgttgtgatggagctaaaataatagccgttcttttcttttt

SEQ ID NO: 16842 - DNA, 1752 bp, Homo sapiens
agacctgagaacctgccatcacagactaattcctcttcccttccgcccacaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtctttctggcctgtttgctttccattcgccggttcatccctctgcccctgcccgcggccgcccgagagggaaagaggattcctgcgggcctcgcccgtcatcttgcaccgcgtccacccgccttcgttggtgcacagtctagatgtctagctagttcgttaagctaattttatgttaatggctctgtatgatttgacagcttgacttgagagccgtggttgggctcagctccccttccctgtcacagtcaggcatctgtaagtgagaagtcagtatgggagtgtcatcggatggagctgggagatgcattgaagggcgtgcggcgggtcagcagacttctgcgactgactgggcagccccttg

SEQ ID NO: 16843 - DNA, 1168 bp, Homo sapiens
tcataaaaggcgtccttcctaataatcacagtcccctctgaaagagagtactcattgttcctccggggccagcgcccagcagtaatggcctcttcctgggagccgctggcattgcttttacgcaaactcatgggaacaaccagtacatggcttttgttttttagtgtgtgtgtctttttttcctgctttctctttattatcttttcattctccacttaacttgctgtcctctgattcagggatgtttccacaattgtcagaattgtgtatgtggaggtctaaattaagtgtctttgctgttttaaaccctgaagtgttttgaccttcaaatgtgccacaattatcttggtcttcaaattctttgctggtggaaatggcttcccagcaaagcgacggcctgtgcaggacagagcctgatgggctttgctggcgtcttttatacgagatgttctccacaccaccactgtgacctttcctacccaattagctcaagtatgaaacctctacatgagatttcatagcaaggaataagggtagcatgtgtgaaatgctggcggctccttgtaagacagattttctatgctccatgagagcctgatccagatactcctggctttcaggaaagtgaatcctctgatgctgcaaattgagattgcttgacttctggtttgcctggcacggccgggtccgttccttcttcattcaagcgaacttaaaatgctttatcaaaatcctcttaggcacaactcttctgtatttaatttcactcttgttgctgacgatcaggctatctcacgcagccatcacctcaagctgctgccccctctcattccgctcttcccgtttgccttgtgatttcatggttaatgttcatgaaccaaagattagactcctacctccctgggagaatcaggaagtgagaggaagcagattatacaggagagagttttttaggatacatttgggtacacctcaggaagaaagagggaagtaggaaacacagtttgggtaaagaatgccatgggctttgttttattttgtcccatcaagtctgaataggacaagtggagatgcactctgatagaagtttcttgcaatcaaggactgggctcagtgtttgtctccgtgcctggcatagagtagcaataactgcacttactattctcga

SEQ ID NO: 16844 - DNA, 1121 bp, Homo sapiens
ggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttcctt

SEQ ID NO: 16845 - DNA, 1247 bp, Homo sapiens
caggcgcccgccaccacgcccggctaattttttgtatttttagtagagacggggtttcaccgtgttagccaggatggtctcaatctcctgacctcgtgatccgcccgcctcggcctcccaacgtgctgggattacaggcgtgagccaccatgcccagcccccaaatcactttatttttaattgaagtatatgtttatccacaatccacataagtacacagctgaattaattatcacagttggaatacacccatgtaaccaaggaaaaggaacattactaggactactttttatcccagcattactattaaagtatatatttatataaactatatgcctttttataatcatgtatgatgtatttataactacaaatttttaatgaacagtgtatgtttagatctgaaaacatgtacttcatttctgtcatctgcctctccaccctgtttctgtctctgagatctgcggagagtctgcactcctgtccttgttgatggaaagttgtgtgaaaagagttttttttaagacaggtggtccagggtgggctgtttgagcaagcagctttttaaagcaaactccccctgggtaagtgggcaggacacttggccctcgtatgcaggggatgctctgaaatatgctaattccagaggaaggatctaacctcaggactagatgcatcagtggctctgacctgggagtaaggctgccccaaattaatacatggagtctcatatttagagcctaaagtgctgtggtttccaaatccactgtgcaccttacctcagattgtgactcaggtagcttagtctttctttggttgctagttgttaatactgttttcctagaaattaaaacagaatattctgaaatgggcttcacagctttctttttgctacacacacagtgcattgtttaaaaatgaaagggccacaaggcttttatcccagttagaaaggtgcatcgtgaacatttcaactggggaattttagttcatcgatcatcaagactttttatgtttttaggaggctgataatgttttctttgactcttaacggttttcctatatatggttctttatcctgagattatatccccattgatttggaaatctgacctttgaaaattccacctgtaatcccagcagtttgggaggctgaggtgggaggatcacttgagcccaaaagttcaagaccaacctgggcaacatagtgagaccccatctctaaaagaaaaaaggaaaatcacacc

SEQ ID NO: 16846 - DNA, 1191 bp, Homo sapiens
actctggctgccctcctttgatttggttttgcttgcccttgagatgaacagccgtggtgtaagtgggttgtgtacctcccctattctgctagccttattttcagtgttatacatggatgtgttaaagtactgagcatttatttttccatcttgagctgtccttgacttggagagggctctgttgaagtttacatgtcagtgtggttggtgtgcagtagactccagccaactcagagtgagaggaattaacagcaggtgggggttgggggggtactccacagatcgcctcggggtgtctacataaatgccctgtaaatgtgaatgaacagcctgtgggtggtgagagcagttttctaaggacagtccaaagccatcttcagatcttcaaggagatccatgattcgtgaaggattcactcctctggatcagaggttctgctgtagtgacactcttttttttttttctctctctttttttttttttcttctctatttcaaaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcaggtaaggcccagggttgaaggccagttcctcaaactttctccgagtgacatatcccagaaacccagagtccctcacctggttagacagatgtggtccgtgcacaccaggcttctgggtgtgcatgtagaatcactctctacttcctacttgaggtatgatttcagagccttgagcatcctgactctttctgtagtggaattttctccatctattaccttattgaagctggggagatatatctatagatatctatagatagatagatagatatctatctatagatatctataggtgtgtgtgtatgtgtgtgtgtgtgtgtgtgtgtgtgtgtgtgtgtatatatatgttttggagacagagtctcactctgtcacccaggctggagttcagtggcatgatctcagctcattgcaacctccaccttctgggctcaagcgagtctcttgcctcagcctcccgagtagcaaggattacagatgtgtgccaccacgcccagctaatttttgtatttttagtagagat

SEQ ID NO: 16847 - DNA, 1147 bp, Homo sapiens
cagttcatgggaaatgtataccacccacctacataccatgacatgcttcctgcttttgtaagtcttcagagtgtactttttttccccccatgaagttggattgtgtccagcagataggtcaagtggttgaatgtcccccttggggtctcctcttggccctgttaccctacttctgaggcttccactcgttttgcattttctctccctgctttttaaatcttcagggcctctgacttctttccctggtgatgtggatatgattttagcctttggttctttagaaacaggagaggcaggttttccctgacataggtccccaagtctacttactggcagcaggaatgaaatgggggagatggtggtaggattaattaggaaaccccatgactttcctgtttctttttcccattttccactttataaaacacattctgatttaagtggaaattgcagtttcagccattaccagcaaatcctgttcattgatgttatgtttcagatgtgttcgccgaagtcatcagaaaaccagggtacagtggaacgaggctcttttccccttcctcagctccgccttgaacctcgagttccttttagacagttccagatgaatgaccaagacgggtgagtccattgcattacagtcacgtgtgtagagatgagtgcggtggtgattctggtcaagatgaggggctgatgaatagaagtgctgtgtctcctggagaccacagagaacttaaccagctcagcgtggcagggtgtgtggggtggtggctgggatttggagctggatgacagattgagtcatgatttcaagtgcctggtagagttgaagttctggcacgtgtgtgttgctgctgccctaggccttagcaaccagcatgtaaaactgcaggacaaggcagaacttctttctgggatgtactcgtttgctcattatatatttcttttaaaggaactgatagaaataattaaatcaaacatgaacctttgcagtgtggaatttatttttggaaaggtatttgattttgcttccgtctgtatactggacatgattccatcatcttttcttttatcagaaaagaaaacaggctgggattgtctcgcccactccgcccactaaggcagctggtggagcgggcaccacggc

SEQ ID NO: 16848 - DNA, 1333 bp, Homo sapiens
aaagcatttggggaggtagaaatctgaagtctttgtcccttaaacctccatgaaagtaagcatgtgagtctgaattcctgggagggggacaattgtttccctgccctggtccaggccagacagacccgccagtctgttcctggtagtaaagcgcatgtgtctatctaatgtgccttttgaggatgtggcccttttgggtctttgttttaaacaatgtctcagttgtatctccctgccctgtatagaaaggcttcatcccctgtcctgagtgttaaggaccaagcctatatctgacaaatgtgcttttcttgcccccttccttggacaggtctttgaaccaggcagggtgcatgtgtgtgtgccttcagaggtcctcaggtcaggaaagattaagagccctatgatgtgtaggtgggtggggtgctgtatccacatgaaagtcagggtaactgttaacttctttgggcctttggttgaccctgagattggagcagggctttctaaatgagatgatgtagatcagtctttgccttcttcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcaggtgagatgaagcctggtcctgctgccttgccactgaaggaggactccaggtcctaattgagagggccctgggatgagctaccatcctaggagacactgcccacgggagacgtgctccttgaagggactcctggttcctctggggaaggagagtgtgaggaggattgcttgaatgctttgtccaagaggctcttttcagatggtgagacgtaaggtgaaggagaagtcccggggtcctcaaatcctgggcacagggcaggcgggtgggggcttcacaaggcaggtggggtccagagcatgggtcttggctcatttctgtggaagtaaacagagttagccctgccacccccatagccccagactcttcacggcctcccaggctccagcttgctcttgctctttgacccggaggattgcctggctcctctgtctccagggggcacaccgtacccagcctgcggccacgacagtcttcactctcaaggactccaggggccaccgaccaattcatggcctggcatttctgagacgtgtttaaagatagaacaaatgttgatgcttatgtttttttttggttg

SEQ ID NO: 16849 - DNA, 1199 bp, Homo sapiens
ccggggccgtggtttcagagagttcacttttcgtggtcggcctgctggcggaaatgggagcggcctctgtggtgggggggtcctgggggcccgcagcatctactgcagcagtcagcgcagcggccgtggccggggcctgcgagagtttgcgcggccagaggactgccccagagccaagccccgacggagagttgccagtgagacccatagcgagggctcagagtatgaagaacttcccaagcgccgccggcagaggggctccgagaacgggaatgaaggctcgctcctggagagggaggagagcaccttgaagaagggcgactgcagagattcttggcggtccaacaaggggtgctctgaggaccacagcggtctagatgccaagagccgaggccctcgggcctttgggcgagccctccctccccggctgagcaattgcgggtatggacggagaaccttcgtctccaaagagtcaccccactggcagagcaaaagtccaggcagctcttggcaggaatatggcccttccgacacatgcggatcccggcgacctacagacagagactatgtcccagattcctacagacaccctgacgcatttggtggccggggctttgaggacagccgcgcggaggacaagagatccttcttccaagatgaacacgtggcagattctgaaaatgcagagaaccggcccttcaggagaaggcgccccccacgccaagataagccccctcgattccggcgcctccggcaagagcgggagtccctgggcctgtggggacccgaggaggagccccacctgctggcaggtcagtggccaggcaggcccaaactgtgttctggggacaagagtggcactgtgggccgcaggtcccctgagctctcctaccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttga

SEQ ID NO: 16850 - DNA, 1111 bp, Homo sapiens
acacctccactctccttagaattcaaggcagagaaactcccagagaaggagccacagggaacaccgactctttcaggtggcatctaatccagctttccaggcgccagaggctgacccttggcttcacctcagttttctgccccaagggccctccggcagggcagtcctggagaggagcagaaatgctggcgtctccattctgagcatattccccttgtctctctcccccctacactctgaacatagcatgtgggagagccctggggagccactttccccaggagcaggcagagccggtgggggcagccttacacgtatgtttgcacacggacatggatgcactgtggccagcctgccgctcctccccacccgaggagtcagctagaggaagtgggcctagatcagggtgccgggcttgtgtgcaggctgtgtgcacgtgcggtgttttccctccttccccagctctggttaacaagatcctctttcccttacagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtaagtcatcctcatatcttcaggggaaagaactcaggcagaaccaggggccatgcagtcctcgggcctcccgagtttgcccttgcactgagtaccttagctttcggaacagctcggccaggccctgggctgggttctggggctgtagaggtgagcagagtaggtaggattcccaccgagtgttgctcacagcccgttgaatccccgtgacaccctgcagcttccgggctttaaagagaggaagcctggggcccagagacgttcggtggtgtgtccgaggtcacacacagctgtaggagcagagctggggtttaagctctttgcgtgttctctcagttgtgcccttgggcctctttggtttggggtaacaatgtgttagatcagaggcggcctgagaaaagtgcggaagtc

SEQ ID NO: 16851 - DNA, 1104 bp, Homo sapiens
gtaggaataggtggtggcatcactgttatgcagtggaagaaaccgagtcttgaagagggtgacttctctagggtgataacagtggaaacttgtccaaggcaagatgcagacctccgtcacctcccagcttctccttcctccccactcctcattcctgagtggaatgagatttgtctccctcaagtcaagtggatcgtgaacgctatactaaaatggagtcagggctggacctgcacacagattacagtccgttggcctttcaggtctttcttggggggtgctttgcttggcatcgcagttctgcttgaggttttgggagacgagcgttccacacatctctggagcattttcaggtggtgtgatttttggtacctgggatacttatcctggggagaatttgtcagtcttggtgcctttggctagactacagcatcctttcttcccctcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccagggtgagagttgggggtgtgaccccagctgtggcacccaaggtcacatcacacactgggtttgcttctggggaggatcctgcttttgagctacgaatatagatggaatacagatggagtacctgtttgctgtgttccgctgctgagctagtcgctgaatgccgtctgagtgatttgctgctgcaacccccaaacggatacacaattttccttgcctaaaattggtagaagagcagagcattcattagtctggtgatctggaaaaggatggccccttgggcttagatcacacagtagtgggaatggccttctttgttggtcgtcgttttctcccactaacttatggaagagaagcaaatgacagatagaccagccgcaagagttcaggagctctcttctgtgctgtgcacccttttcttaacatggggaaggctctggaaacccctccctgaatgctcttctggaaaggcaaactgagaccagaagacggtatacgttacttcttagaacatttgt

SEQ ID NO: 16852 - DNA, 1147 bp, Homo sapiens
cagctgtttggtgcttgtctgctttggggccagtggggcggggaggggtgggagtttgctctgaatcactcttcagtccgttgttaactgtgctctaggagaggcctggggcgagctgatatgtggtgggccgtgttttgcttttccatgtcatcttgcctcctttccttgctccttcctcctcctctccccttgactccctgtctcctccccaccgcgggcttctccgtcagtgtggctgccagtcattgtggctgatgtcctgtgcctcgtacagcctggatgtcttcacttgtttaatccagcagcatcagcgccatctaggagcttgttctcaggccccatcctggaccctctgagtcgcgctctgggggtggggccggggatctgtggtttagcaagctctccggggatctctgaagggtgggaccagatccgcagctggactcatccacctgatcccgaccatctgtctggcttttgcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacaggtcaggaattcagtcactctacccaaagccctaggcttctttccttcacgaccttgccttttcttttcacccgcctctcagtgtgtgctggcctatcgtgctgttggttggtagccaccgtgcccattcctcagcgtgcaggaaatcagcctcttctgagtagccccatcacctttttttttttttggacagagtctcgctctgttgcctaggctggagtgcagtggcatgatctcggctcactacaacctctgtctcccacattcaggcgatgctcctgcctcagcctcctgagtagctgggactacaagtgtgtgccactgtgcctggctaatttttgtattagtagagatggggtttcaccatgttggccaggctggtctcgaacccctgacctcaaagtgatctgcccgccttggc

SEQ ID NO: 16853 - DNA, 1063 bp, Homo sapiens
gcactcagggcttatggggagggagcagagacggcactcgcgccactttccttactaggaggggggtttctaagtctggtccttcaaccaagggactgacaacttaggggagctttccctgcaactcaggagcaggaagggagtggtgggaactatgtatccaaacacgtttcagcgtcagggtcactttgtttttcccattcatctgtccaaaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgg

SEQ ID NO: 16854 - DNA, 2883 bp, Homo sapiens
cctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctgtgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgcgatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaagctgaacgtgctttctcaggttgtacatccctcgtttcttggtcatttgaccagagagacctacagatcaaagaattctaattttacagagttcacacggaaattaggagtggcacggctgaaatgccttaacagaagctgtgtgggtagagaagggattgaaacccgtggctaagaagcatcttccaaatgcggcagcatcaagcactccaccctcttcccacggatggcatctggttgtgcacagtgcctgcctgtggccccgtcacttgccgtgagaaacgagctggtcagaggaggtaagcatttgatgtggcgtgttgtgttgtcacttctagcggtgcttttgcaggaagtggaggaggattatgctgtgctttggggtggggagggagcaagccaggcctggggtagcgaagggtaaaaggtaagaatgggctgaggcagcagttctcggttttgccattgcctcactgacctggggaaagacgtttcaccacctgagtcagtctccttaatca

SEQ ID NO: 16855 - DNA, 1962 bp, Homo sapiens
tgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagt

SEQ ID NO: 16856 - DNA, 1148 bp, Homo sapiens
aaagcattcaaggtggatttcaatgtttaaaagttgcagtgtttgactcttaaggaataaaacctgagagattcatccagaaattcaaaatgagtaattacaatgacattgaatttggccacgaagttcctgagcagacaagacagcgatgggccacgcaggttttattttctgtcccagcagagcatgtggccacttgagccgttctctgtgtcatgctgtttagatagccctgaggacagcgctgttcactctccagtctcagggcccttctcaagggaggaggtgctgggtgtgggtatcacagtggcctgaggactgggggttgcttggcgtgattggtggcccgttagactaagttattgtgaacggcctgtcactgctcagctactgccaatctaattactttttctcttttcttcttgtattctcgtttttgtttgttctccacctggattctgtagtataagtctgtgtttaggtcctactcccaggatttcgtgcctcaccaccaagcttccgttccgcctttccttccgcctacctcctcttcctctccacatttcccacctgcccaccagtctcagagctctgacttagccgtgccaaccatggccggtccacctcccagcaccgtggacgggcctctctcggcttctcaggagagcagctttcatgggaatactgtctgccttccttccgaaacctctttcactgactcggtgagaactcagcgtgcacacacacacacacacacacacacacacccctgcacatggggctgcacgttttttaaaaagcggtttcacgttcctgaaagacactgcctcccctttactagcagttgggggctgccagcgcacacctgctggcagcatggctgagctgacagctactgagggtcacaaggtgcaatgggagcccatgtgtttccagaacagaactgactcttctatacaaagttctatcaaactaggaatctgattttccacaaatggattagtggccatttagagaggaacttatcagacgcataagatacaaaatgctactagctttccatttacttgtctgtttttagggaaaggtacaaagcccttcgcaagtgtggaggtgacagattcaggacaagtgtctgttcggttgca

SEQ ID NO: 16857 - DNA, 1397 bp, Homo sapiens
tacagccaaatataaacaagcaagccctgaagcagaaggaagagcagggctcagtggtggctttggccccctggttcttatgtctgtcactccacacacgcagtagggcttcaggagatactggctgactggtgctctgagccttttaccagaagagcctgattcagctaaatttccttggtaggggtgactgcttagttggaatttggtggctggaactggtggtcaccccctcttaccctacacggaccttttccaggttcagcatttacagatttgtttcccaaccaggaggggcttatcctaaggaatgttctgatctgagatgagattagaacttcccctgctgtcgaagtcaaagggtcccatctgcctgtcacttcccatgtgccctgggctgtgctgggctagtcatcagcccctccccgtctttggcccaagatgtggaaaatcttaatagctcaaccggttccctcagacctttgtcttctgaaacagtgcttctcacactccagcactgcagggccacctgttgaagcccagtgtcctgggtcccttccccagagaccccagttcatcagattcttaggtttgcaccagggctaaagagctggcatccagaccccctcccatgtgacactgatgccgtcatctgatgcccagtcccttttcagctgaacgaaggatgaagacacaatgttgtcctaaaattgattcagtgaaatagcaagtagtgaaaaagtaaaatagaatttaaatctttagatttttgacatattttgtgtacttggttgtaatataaaatacgtttcttaccggggtcaaaaagcttattagcctctgccttagctacttctccctctctgaaatgcccacctgtgcctttgcacctgtgcttggtccttagttccaggctcaggaggggaagctaaccagtgtcttggcaacttttggctatgggctaggtttgcggtcttcaccaccatacatgacccctaacctacagcagcacctattggcccagtgagggggtttctccactccacactccagggagaagggtcttcacatgtttcaagttggttgtgattaagtttcgtgaaacgatattagccttaatacatgcatggcctctgagattttctgtttcatgttttcatctatgacattgattttgggaagtgctaaatgggttggttgtgcatcgtaaacatcaacattgggagtaatccacaaatccacccctcaagtggccaggaccagttcccacaactctccagggcacctgttctcccccagctcaactgccctgcactttccacagccagatcctgcaccgtctgccagtctcggttccagggcctccattcatgaacttttcctgcatctctcacaaa

SEQ ID NO: 16858 - DNA, 1303 bp, Homo sapiens
tctggggaaccggaccaaggtttaagcattcaccttggggaggccacccccacccctctctccagacttggttaggggtctttggcctcacttgtgtagcacttgtcccctgacctcggtagcgatgcttcaggtctgccctccccgcgcctccacagggtttcttgttctctgaggagtaggggacaggacagaggcttttcctcagcaggcagccagctcagattggactttccttctagggatccctcttcaggttgggttggtgggaaggccgtctgaactggagcaggtgggctgtgtcagggaggcggtcaccggactggactctagccagcggttcccacctccacgcgcccaccgcccaagcagccagagctccagccctagccgcccaaaacaatgcagggcaacggttttctcctgagccaagtgtggagacctagatttccttgcacctgagggagagggaccacagtggtggcttctcacgccttggggaaccggaccagggcctgttcataacacagagatctgagctccttctcaagtcaggctgactgctttgggtaagagggcagaattttaaagcaaaaccgtgctctgcagggcgcctatttcagcattttcagactggtcttaacgtagttggttcattgccctcagaaatgaatgttgaaagcggtaagccccatttgaagcacccccgattttaacaagcttcaggacacatagttctgtgctaatatttttgttttgatgaaaaatttaaaaacactgctctcaacccccaccacaaagaacacgaaaatattattataaagaaactagatatatcccaatccctgctctgcagtggtggttcaatttgtaaagcaaaagttagaaccaaaaatgctttcaaaggtggcttcgaacaatgttcataactctctgctcgcatcattctgctttttacagagtttagagacccatttatagattcagtccacggattgtcatgcatttgcaaaaacgtctactagctctccgagttccatatttttattatcaagggacccttagatctgaggacatggggactggcagacaccagctgcagaacggaaccgtcttttaggaaacagaggccacgatgagtacatgatgggccccatctacctagtggaaaatgaagcggcatgtttttcttcacggtcactggtggctcttggcaatttctgactcagcaccattggactttctcctggcccctcctttcctctctgttgggtggggcggccgggggggtgcttttgtagcc

SEQ ID NO: 16859 - DNA, 1060 bp, Homo sapiens
gaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatcatttcgtctgccatttggtttgctttatgctgaaattacttggtggggatttgtgcaattcagatataaaaagtttcattatccagcccggccctccttcctagctccttttggaatcttctctgtacagtaatgaggtgcattgaggccagctgtgctgtttagttacagactgaagtttggtccaacagaaatatgtgctgatcattaggctggaattggggtggaggtgagataggaggaacagatgaacagtgacccgtgaaaggagctgccagaagcactggtggagggacagggtagaattgcccttgccaggggtaattgctgatggttatggaagtggaacacactttataaaacaataaacttcag

SEQ ID NO: 16860 - DNA, 1035 bp, Homo sapiens
ttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaat

SEQ ID NO: 16861 - DNA, 1146 bp, Homo sapiens
tggcctagcttgtaagtgcaagtgaagcttacacccagatcttcccctggcatacatgctttttccactgtatcacatgtgctaggaaataaatagtcttgggatgttttcactaaggagaaaattgactaaagaaggaaaaaaacagagtagtaaatagaagaaaagttgtggattagtaaatgcaatttattgtgattatctttgtaagaataaaaaataaaagtacagttgtatttgtaagtacttgaagcgttacagacactaattagtaattagtaagtaattagctttctttccagtagtgaacgtgctttttagattaaaggtcactttggtgtccttgtcttgtctgaccataaccaaagcttttgtctcatgcattgaaagaaatttggacaggtctttttcatgttcttcctttcaaattccactacagaaacagcaactcattctcaaaaatgtgttttttatatagattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagaggtaggtatgggtgagggcactgatgctgttaactagctgtatcattttactttacttgagttaactgacatgtaaataagtattaacatgccatttcctctttgatttgtatatattttttatattgtgtgtaactgtgtcagagaaaagggtggcagagggagggaaggttatgggaaataaaaagaggaaaaaaccactatcttatgtgaaacaaatcgtaaggactagaatgatggtcttcaggcttcacggtaggtcacgtagaatgctgtgaatgctgggctgcattttggttggattgtggttttttgttttttttttttgagacagtgtctcgctgtcatccaggttagggtacagtggcacgatcttgactcacagcaacctctgcctcccaggtcaagtgattctcctgcctcagcctcccgagtacctccctagtggctgggattacaggcgtacaccaccacccacagctaatttttgtatttttagta

SEQ ID NO: 16862 - DNA, 2243 bp, Homo sapiens
aagcctaagagaaaacgatctgaaaaaccaatggctgaagatcctgtgaggccttcatcttctgtcagaaatgagggccagtctgatactaataagagagatcttgtgggaaatgattttaaaagtattgatagaaggacttcaactcccaattcacgtattcagagagccactacggtttcacaaaagaagtcttcaaagctttgtacttgtacagaacccatcaggaaagttccagtttctaagacccctaagaaaactcattcagatgccaaaaaaggacagaatagaagttcaaattacctaagttgtagaacaactcctgctatagtgccgccaaagaaatttcgtcagtgtcctgagccaacttcaacagctgagaaacttggcctgaaaaagggtcctcgtaaggcatatgagttgtcccagcggtctttggattatgtagctcaattacgtgatcatggcaaaactgttggagtagttgatacccgaaaaaagactaaattaatttctcctcagaacctgtctgtcagaaataataagaaacttctgactagtcaagaacttcagatgcaaaggcagatcagacccaaatcacaaaaaaatagacgaagactttctgattgtgaaagtacagatgttaaaagagcagggtcacatacagcacagaattctgacatatttgtaccagaatctgataggtcagattataattgtacaggaggaactgaggtacttgccaacagtaacagaaaacagttaataaaatgcatgccttctgaaccagaaaccataaaagcaaaacatgggtctccagcaactgatgatgcttgccctttgaaccagtgtgattctgtagtgttaaatggaacagtaccaacaaatgaagtaattgtctccacttcagaagaccctctgggtggaggtgatccaacagcacgtcatatagagatggcagctttgaaagaaggagagcctgactccagcagtgatgcagaggaagataacttatttttaacccaaaatgatcctgaagatatggatttatgttcacaaatggagaatgacaattataaactcattgaactaattcatggaaaagatacagttgaggttgaagaagattctgtaagtcggcctcagttggaatctttgagtggcacaaagtgtaagtacaaagattgtcttgaaaccacaaaaaaccagggtgaatactgcccaaaacactctgaagtgaaagcagcagatgaagatgtatttcgtaaacctggcttgcctcctcctgcatctaaacctttgagacctaccactaagatttttagctcaaagagtacttcacgaattgctggtctttctaaatctttggaaacttcttcagcactttcaccgtctctaaaaaataagtcaaaggggatacagtcgattttgaaagtaccacagccagttcccctcatagctcagaagccagttggtgaaatgaagaattcgtgcaatgttcttcatcctcagtctccgaataattccaacaggcaaggttgcaaagttccatttggtgaaagcaaatattttccatcttcctctccagtaaacattcttttgtcatcacagtctgtctctgacaccttcgttaaagaggtcttaaaatggaaatatgaaatgtttttgaactttggtcagtgtgggccccctgcaagtctttgtcagtccatctcaagacctgtgcctgtcagatttcacaattatggagattattttaatgtttttttccctttgatggtattgaatacttttgaaacagtaagtatgtgtttcatttgtatgcctctccaaacttttcaagttacctctttaccttgctgagtgaaaatgagagtatagttcaaaaaatcagccaggcgtggttgcgggcacctgtaatcccagctactcgggaggctgaggcagagaattgcttaaacccaggaggcggaggttgcagtgagccgaggtcgcgccactgcactccaacctgggcggcagagtgagactctgtctcaaaagaaaaaacaaaaaaaagtatagttaaattaaaattgaccgtttcgatttagatactggttttagatttcatgttgaacagacatttgtgccagccactgttttagatactggcaatacagaggaaacacttttttttttttttttttttaggtggagttttgctcttgctgcccaggctggagtgcaatggtgcgatcttt

SEQ ID NO: 16863 - DNA, 1143 bp, Homo sapiens
acggctcgcagcaacctcgtcttcctgggctccagcgatccttccgcctcatccccccgagtaactgggaccataggcgcgcgtcaccacgcccggctaattaaaaacaaaatgtgttgcagagacagggcctggctgtgtttcccaggctgagctcagctgctccagggatcctccgagccgccgcgcccggccggtcccttcgtttggaggagagtctgtttctcccacttggaggggctggagcttttgctgctggccacaggactttgtccgtcctccccaacttctggggatctaaggatgtgcccagcaatttgcacgacccaagtgaaacgggggtgactgccttgagggaaaagagctccacaaggagaaggccgagtgtggtatttgataagtgacacagctgaggatcctaggattgatgttacctgcgcgggctaataacttgggggatttttggctcggtgcctagctgtccccgtgagtggggacagccccttgtggaactgggagtcagaattgcagttctgctgtttcctggaagtccacagccaagttgtctaacctatctgggcttcctcatcagccagcagtatctgtctgtaataggatcgataccaggctcagatgggatatagagtataaatgccacttaccaatttcgttttttgttttttaatttcagaaatgttcttttggggccagagtctgggcatatatgaatgcaaatccgtgtttgttcacaactaagcccagctgagacgatcacttttctgtaggccatttgtccaggtaataatttttttttttagcaggagttcagagcaccaaggtaagtgcaatgatggaaacatgtgcagagtcctaaagggacagagaagaaggtcatcagagatagactggaagagaggacgggtcggacaggccccccccccagacgtgatgacactcaggaagagcttgcacactggttgttctcaaatccagctttctcttcgaatcttagtggagttctttaaaagggaaacaattttatccataggatcttttctacttttttttttaagttcctgaggtaagtctgatgtgtattcacagttaagtaccgggcagaggtaggagggtgggtttccaagg

SEQ ID NO: 16864 - DNA, 1166 bp, Homo sapiens
tgaaatgaagagccgccgcttcctctcccagccgaccccagccttattaacaggcttcgttttagggacgcctcctccgcctcagctatctgctatgctaacaggtcagctgccattttgtgttaaactccttctcatttattacaataccactttttattgacatggaaataaaacttacaatcaataagatattatgaaatatacatcaaaacaaaagtcactggagcgggcgttttcatctgttctcaggaaggaacaagggtttatggttggggggggggggggcggcggaacactgaacatttttcttccctattacatgatgcgattttcaatgaatctataaagaaaatgaaaacataaatagagtaaccaaacagaatgatccctgcagctgtcaaaacttaaaacagttcagttttcctttgatttctgttttaagttttgaaaagtacatagatcattctctgctttttccttttctctctttctttctttctttttttttttcttttcatagggagcctttttcttaaatctgctcactcagggtctgctggctgtgacccttgacagctaaactgaccaaatgatcaagtggactctgcatttctttcgtaggctgccggcccggcctcggtgggaacctcttattctgtttatgactcctcagcggtgcagaaagttattccttcccttgctggacaccacatcaaaggaggcccacaggtgtttcttccttctgctaaaataatgtcaccctggagaaaaaggggaaaagaggggcccctcccggcttccgcacacctactgcgtgctgggcacccgtggcgcttcacctccatggtctcgtctaaatgttgtcattacgccatggggtggggacggttattccctgtttaatgagtgatgggaaactgagactccgagaggccaagtaacttgctcaaagtcacacagcaaagaaggatcagagtccggttccaatcctgcctgttgacatcgagtgggcgctggcaagggctgccaaggcagcctagttggattctcattttttttttcttaagaacacatggacacaggaaggggaacatcacactctggggactgttgtggggtggggggaggggggagggatagcattaggagatatacctaaggct

SEQ ID NO: 16865 - DNA, 1878 bp, Homo sapiens
tggtttggaactgccttcgggctccagaacttaaattgcttggtccgtggcatctgatgtaccaacagagattaaaagtgtaaagcaacacatgggctgatgttttgttctcagaaaatagctgctggtctgcatccctccattcttgttttttatgcatatggaaaacattttcctaaaactctatattcttaagttgaagccaagactaaaatttaatgtgtcaaatgatctggtgactattataatgaataattgtgacttatttttcattctctcctgggtcatcaggtttcctgacccaactccttaatccgtataaagatgtcaaatactgtagttcacccacgccacagccctgcttcagacttaactgtggtagcctagatgagctatttgtacacagaggaaaaaaagatattttcctcttttagtaataagactttcagtatttttaatgttgacatttccagatgtttcatttagtatccaggggtctgtctggagacttctagagagggacagctcagaagtgagacccttgagctctggtgctgtaagcttgtgcaattaagttgaacagagcctgggaatttctttcctctgcacagtcccttgatatttggaatccaggttctgcccccaacccctacccacccagtggtctgttaagatgtctcagatggggctgggcttggtggctcatgcctgtactctcaacactttgggaagcaaaggcaggcagatcacaaggtcaggagttcagcctaaccaacatggtgaaaccgtgtctctactaaaaatacaaaaattagccaggcgtggtggtgcacacctgtaatcccagcactttgggaggccgaggcagacgggtcacttgaggccaggagttcgagaccagcctgggcaatatggcgagactccgtctctactacaaatacaaaagttagcctggcatggtggcgcatgcctgtaatctcagttactcaggaggctgaggcaggagcatcacttcaacccaggaggcagaagctgcagtcagccgaggtggcaccactgcacttcagcctgggcaagactggagactgcctcaaaaaaaaaagaaaaaaaatgttggtacttagatgataccatgacggcaacctccccacccccaccccgcattgataggtagtgcagaccagcccttggaggcacttctaaacagtctgctcagaaatgttttctgtttcctattcaaattgctgttttgtctcctatgtttaatcatgtatttgctattctgcttatttttctcatttggtggtaatttcaagaagagcgtttatccactattgattttcaagaaagaaaccaagcagcattgaaatcatgagtaacagaattcagaacattgtatggtggaagtcatttgtgtctgcagctgttttttcactttacaataaataagagtaaaaattgagatcatgtcaaaaaattattgcagttttaatcattatggcatagtttcacttcccctccccccattagaatcagtggagatttgttcttactagggaattttggactgctgccatttaaaacttaggtttttatttaaagcagttgtgcatttttgagaaaatgtattgggagtaactagagaggatctcccaaatttttttgtatgtctctctaggagtaaacatggcaacagtttttctagaacgtggactcactgcagggactggacccaatggcattgttaagaccctaaaatctagccaccacctgcctcccccaggtttccacacacccagttggaaggcctttccctgcccttgtccctgtctcacacccatggaggttaagctacagagctggggaaacaggagattt

SEQ ID NO: 16866 - DNA, 1121 bp, Homo sapiens
tagatttcaaggaagggttactaggataatactaccagcttactttccataaagttgtactagtttatatttctgttatcagtatactaaaatgccttctcagtccttcttacattgtcttttcaaaatggatacagcatgtttattttttataagtactaattccagtcttttttttttttttttttcaggaagtagaaatgatgaaagccgcctatcggaaagagctagaaaaaaacagaagccatgttctccagcagactcagaggcttgatacctcccaaaaacggattttggaactggaatctcacctggccaagaaagaccaccttcttttggaacagaagaaatatctagaggatgtcaaactccaggcaaggtaactttcatcaggaaaggcttttgtgtttttattaagtggaacttcctatattctggctggtctgtatctttcagaggacagctgcaggccgcagagagcaggtatgaggctcagaaaaggataacccaggtgtttgaattggagatcttagatttatatggcaggttggagaaagatggcctcctgaaaaaacttgaagaagaaaaagcagaagcagctgaagcagcagaagaaaggtaggaacaaagaactgattcatgaccttgggactaagctgccaattccagcataaggactgtgtcacgtggtgtgggaagcagttactgctgactagacaggctgcaacactcagctcactccgtgtcagagacccactctgacgttcctttcctcaaaacgcccagtgatctcttcgtgttcgtgttcctggccttgagtccctccatatggccacaggaagtgttcacacttaagattgccacctactatccctagttgtgatttaggtttctcttgatgagatctcttgagtccagtattataaaacagagagtgggctagcggagttcagtgtcagtgtgagtgagtgtcagtgtaattccacatcctccgaatgtggacagtccaatcaccagctccttttttcctccccggctttcttacaggcttgactgttgtaatgacgggtgctcagattccatggtagggcacaatgaagaggcatctggccacaacggtg

SEQ ID NO: 16867 - DNA, 2411 bp, Homo sapiens
gctgggcacggtggctcacgcctgtaatcctagcactttgggaggctgaggtaggtggatcacctgaggtcagcagttcgaaaccagcctggccaacatggtgaaaccccatctctcctaaaaataccaaaattatccaggcatgtagcctgtagtcccagctacttgggaggctgaggcaggagaatcgcttgaacttgggaggcagaggctgcagtgagccgagctcgtgccattgcactccagcctgggtggcagagggagactctgtctcaaaataaataaataataataatattttgctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagacttcatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgcccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaaggtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacatggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaagtttgagacccattaaaaaagttaaatgagaaaaaaaaataataataataataataataataatattttgagaaactgccatactgtttccacagtggctgcaccatttacattcctctttttatgttttacacatctgctgtttggtgaaattttctacagagtagcttttaactctgagcgctgtacttcctttgaccctggacttcacgcccaaacatcagtaaactgtcacagaaggtagtaataatgtgtattcctggaagccatttctacatgggatgatcagtgataactattaaattaaatgactgcaagccacacatgcagtccattcaatccaaactaaatgcattcccaattcaacttcccctcagtcaaattccccaaatgcc

SEQ ID NO: 16868 - DNA, 1207 bp, Homo sapiens
gggttctggagtcagtccctgtttaaacaagagtcatcaggttttgtgaggacctcagcagagtctgtcctcaggcaggagtcattgagaggggtccttggagttctggagctgtattggaggggatctgaggtctgtggctcaagacagtccttgtatgggctctcaagcggtaggggtatcctgcagggcccccaggagcatccctgatcacccctctgcccctccccaccagagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggagg

SEQ ID NO: 16869 - DNA, 1361 bp, Homo sapiens
aacccatcatcctgacccttgtggggctccgtaagaagctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagctatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctgtggcagaagcagttgccctcctctgtacattgcctttaagcgaccaggtcctggccgagtttcctctgccccttcttgctggtcccccaaagggcgctccgctccctgccctgccctgccctgccctgttccgcatgagctgcgcctctgtgctcgcctgccccctctctgcttgttagttgctctttctggctctgcctctcctttgctttcctcgggatgccactctgtgcccaggacggttctgagactgaacactgagggcaggagcaagggaggaagccaggggcgaggcaggccgcgggaaagccagggcccctgcctgcaggttagaaagaggcgagcgtggattgtcacagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggcagggacagacccagaaagaac

SEQ ID NO: 16870 - DNA, 2427 bp, Homo sapiens
cacctccggagctgactgagagccctggccgggtagtgtccaggaagagctcctggcgccatggagagaggagagaggatgtttctggcctggatggctgggtgggccaagaagcacttgggaatttagttatggattagagattcatcttggtaaatcacagcctgttactagttgggaacttcagtcttccccaaaccttccacatttcaaagctggtgctttattgcctcctgcctccctttggcttttatctccctacttgcaccagcagccgtctcagcagtagctacatcagcctgatggatagagacttcatgacgtgcagcagctggaacttttgtttataaagcatctcttttcctcacatttattttgaatttcttacgtttcaacctatgcagattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcacca

SEQ ID NO: 16871 - DNA, 1099 bp, Homo sapiens
gtgatcagcctgttatctttgccttttagggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcgggtacgctggtctcagggagtggggtctgctggggatgcttagccgtggagggcggggcttcttcaaggaagaggatgctttcctctccctgaggtgaatgaggcaagcacctcccagggtcctgctaagaaccaggaccacacagagcttgtcacgtgggtgcaaatgagtgaggggcagagagcttttctctgctgacacttagtccatggatccctggggctctgacctggagccctgtggcctgccgtgtttattaaactacagcctttggttacccttcagcctgacaagagccttagccttggactgtgagatggtgggcgtgggccctaagggggaggagagcatggccgcccgtgtgtccatcgtgaaccagtatgggaagtgcgtttatgacaagtacgtcaaaccaactgagcccgtgacggactataggacagcggtcagtgggattcggcctgagaacctcaagcagggtatgtcatccacagctcaggaacttagaagggaaagtagtaactggattcgttttctcccttttgttcccttttctgtctgagaccactcactgcagctggttttgatgcgtcttgtctccttttggggcgatgggttttaaaatacaaaaggcatccttagacggctttacacccatttatgccttgcacttcattgcctcctgtccgctgacttcaagaccaggccagtagctgggcacggtggctcatgcctgtagtcccagctactcaggaggctgaggagggaggattgcttgaacccaggagttcaagtccagcctggacaacatagcgagacctcatttctaaaaaaaattattatttttttttgagatggagttttgctcttgttgcccaggctgaagtgcaatggcacaatctgggctcactgcaacctccgcctcc

SEQ ID NO: 16872 - DNA, 2356 bp, Homo sapiens
gggtctcacagcccccaaactgactgttaagagcaggtttctctgcttgtcctcgaagggtctcgactgagttttgttccccgccataaccggggggtctcccccgagggatggtggccctttgtggaggcagcagggcctccagtttgccttcccggggagcctggctgggtagctgttagggctggaagactgagccatggccctgctgctgggggctcccctcgcctccccggagctggcctgagaggtcccgaggcggccggcgagccgtctggacttgggaatgagctctgactggtcaaggccagttcactccccaagttgtttgaaagctgggcgtcctgcaggtaaacttcagcaggtggctgcgttgcctgtgaggttgtgtgggggatcctggccctggatcctgcaggctctctttctcgagacccccatccatgcctggtgagagtgggtgctccctggagcccgctgctgtccctggttctgaaggtctcagacctctttgagaaaacgcatgtgaaaggacatggagtgtccacagaacctgccaggctggggaacagcgctgcctatgtcccgctctgcacagtgtcctcatgcccagcgctggtcccgctggtctcgagctgtccagtccatccaggcaggggctgggggcaaggggcagttcctgcttcctgccagggtcctctgagataaaacagctgctccatgtccttccctgtcatgtctggagctctctgaacagccccagtggaaggtaatagagatggtgacttccccaaaggaagaagaagccagaggatggcagatgccatttcctgagcctgggtagggggctgctatgggagctctggcccatgagccatcgccctgcccagctgggcagcacgaggggccgtgatgtggctttgggtctgttggctggttgtggggtggcgttcctgatgtcccaggcccagcttgccaggacagtgtgggccctgctaaccggcgctgtttctggttctttctccacgcttgcagattagatacatgcaggtgagtggcccggaaggggaggctggggacgtcctgcctgcgccgtcttcttgacctttcagggaggtctcagacctctctgagaaaactcgggaccctgcccccaggaagacatggtcaggcacacatgacttcaggcatcagagaccctcggcacccccgtggtcctgtacccacagccccatcttgcacgttgccttagagacctgcagcctggcagacccaagcggacccttggggatttcttggaggatgatgatggtcttagggccgacacgagcgctgtgggtcacagcaccatttctccagagccttctgacaggtggggtttacccagcctaacagaaccttaaagacagtgttgggaaaatccatcactgccccacagtgaccccacctgtcacctcaccctggaccatgggccaggcaatctctaatcctgtcccggccacattccaccagaggtgggggcaggccctgctctggaggaggctccagggaccctgctggcggtggggggtcatctcaggccccctggctagaaaccagtggacactcaggggaagagtccagcctgcaggtggctgtactgacatgtgcaatggtggatgtggtctgcatggagccgagcacacagtctgccacgtagagaggacttatgcacacagtaggtgttttagcaagtcactcctgctcctgtgctggagggggtagcttctgaggccctcaccccagtctggtgaagaatcgagattcagaatcagaggagtaggagcctgggattctagaaggctctgcctccaagccttccttggcactgtccccacgtcacatcccctccccgtgcgtcagtttcttcatctgcaaaatgaatgggaaggggttggccctctctgtcacccatctggctgcagcactgcacactcagtgacctcgtggccaaacccaaggagtcctcttttgtggaggtgtccgggtgtcgcggtgcagatgtgcaggtggcaggtggccgggcccatggggtcctgctgactcccccttccctcctctagaaaatgggcatgactgaagatgacaagaggaactgctgcctgctggagatccaggagaccgaggccaagtactaccgcaccctggaggacattgagaaggtgagggcagatggcggccactggaaaatggcagcggccactgtggtcactgcagggccacctatctcctgggagtgcattccggaggcagggccatagggcctctctgacaggcgaaggagacttggtggccctcccagctctgcctccaggta

SEQ ID NO: 16873 - DNA, 2876 bp, Homo sapiens
ggtgtgcgagcgcatctccctgcccatgtctccacagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcggcggcctgtcgtctccaggtgctaactcctgccaccgcgcggtgctcacccacgtctgttcgcgcgctcgcccctgggtttgttgggttttttggtttttttctttgtggtttttttttttttttttttttgtatgaaacttggaggcttacaggtatagacagctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcg

SEQ ID NO: 16874 - DNA, 1265 bp, Homo sapiens
ggactctggatgactagacaattgtgtcctgctcttagcctcagatccttttgttttctttcagctgctgataaacttattaaaatttggggcgcgtatgatgggaaatttgagaaaaccatatctggtcacaagctggtaggtttcagccctgtgcggtgaagttgactgttgaacagggtggctctagtgatcaaggggtcagggctgcttcgagagctgtgggttcaggttttaagttttccccgttttttaatttttttatagttatttgcatcttgaacttttaacccaaataacatttgacttccatggaggagtgtctgtgaggctggcagagctgcagaaagcctgctgtttttctcctgggccgtgtgtcttttgtaaggttaacactagtgagaagatttcctgagggcaatggggatgtttgggattttgaccttttgccgatggtcctattttgtcctgtcaagttactgaccctgttttttctccccaagggaatatccgatgtagcctggtcgtcagattctaaccttcttgtttctgcctcagatgacaaaaccttgaagatatgggacgtgagctcggtaagtgacactcagtgcttctctccaggggagaccggctgcagggcacggggcaggtgcgggggactgagttgactgctcagtaagcaacactcagcgctcctctccagggaagactggctgcaggggcatggggcgggggtgggtgggggaggccgagttgacttcggggaacagcaagtcactggcggggcatcaggcatgctttgggatgtcagacattgatgaatgtgacctgactcttacgtttggggaaataagcactggaataatcctaataatactctgttatagggcaagtgtctgaaaaccctgaagggacacagtaattatgtcttttgctgcaacttcaatccccagtccaaccttattgtctcaggatccgtaagtgtggctggggtgtcttccctgggggaggtggtgtcggatgtgggaaggctgttgaatttgcttgtagccactgtggagaaggcaggtgggccctgagtcctttctgtgctgtttgtggggaggatgggctgatagcaggtcttaggttctggggaggtttgtcccctctccttcctgtaaaatcactgtcatctcttttgtgttcagtttgacgaaagcgtgaggatatgggatgtgaaaacagggaagtgcctcaagactttgccagctcactcggatcca

SEQ ID NO: 16875 - DNA, 1146 bp, Homo sapiens
aacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctgggggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcagtgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctc

SEQ ID NO: 16876 - DNA, 1097 bp, Homo sapiens
caccacagggtcctgaacacccgcagttcccggggcagggccgcgtccggaagtccgtggaacggatcttccgatccttgttctctgattcgttaccaaccttccacttccgtagacagttcttcccgccttccgccgtctgctaggcgtgtcgccgcaggaggtgcgcgcccgccctgttttgtttccgggggaatctacttctctgaaggacgctcgggacttccgtttgttcccctcagcttctaattggctacttttatgaatatattagggcacgaaaagtggtagatttttttcttacacgttcaaattttaaaaaagacgattaattgaatgcgaacatttgtggtttcccactgaaccgtgacatttttataaatgtacctccatggatagcgaacaagaagtcaccctcaccgaaaggcgagtggagctttcgtccttaaataaagtgcgcagggaagccgaggcgtgttgtatgaaaggagagaaggttagcactccccttgacaaggatggaagaggccctcgggcctgacaacacgcatacggttaaggcattgccacctacttcgtggcatctaaccatcgtttttttttttttggtgttttgttttttatttttcttcagacggagtcttattctgtcgcccagactggagtgcaatggcgcgatctcggctcactacaacctgcaccccctggattcaagcgattttcctgcctcagcctcccgagtagctgggattacaggcgcgcgccaccacgcccgactaatttttttgtaattttagtagagacgaggtttcgctatgttggccaggctggtcttgaactcctgacctcaggtgatccgcccgcttcggcctcccaaagtgcggggattacaggcgtgagtcaccgcaaagccccggggcatttttcgttttatcttttatcttctttccttgggacacgggcgcgggtcgcacttgtgcacgggcgcgccgttccgccgctgcttggggcttttccgttcatcttcaccgcccgttcttggcattgggtcgtgttcgcgtctcgacacccgacagggcccgtctcccgagggcgcc

SEQ ID NO: 16877 - DNA, 1091 bp, Homo sapiens
ccttccaaacctgggccaccccaacctcggagaggctccccactgagcacccaaagcacctgtgaccccataccctgccggtgccctccccccacccatgcagccccatgcccgcccttctccccgtggacctgccaccccgacacctggacagaagccggctctggtccctcatctccttctctccttggccttgtggttcaggcccttgtgtcctgtcccctccctgctctgtgagtgtctggtcactgtggcagccatagggtagcacctagaatctgtgttggacaccggtgcgtcacctgttgcttcccgggcaggggaagcacctggcctgtgttccccccctctgccctccaccccttgcccacaggaggtgctgcaaagcctgcgtggcgttggcggggtgctggggtctggaggagcccagccagtcggttgtgttggcaagagacgggcctgaacaagagccaagtggcttctgcgtcagcttttaaaaccaccaaaaggagctcacttgtcatgctgtggtccaaatattttggccatttagatgcaaccttctgtgcctctgaaattaggtgtattattaatctcatccagcccagtgacagagtgggcagatcagacaaggatccttgcagcgggatgaagggtgagcatgttcttatcggtgcaaagctgacacggggtgtttccagaatgacactgatggagtgcagcctgcctgggggaggggtggctgggaacccccggtgatgaggagggcatgggcacagggcttgcttagggaggagaagagagggctccagagacacggttgctggcttccagggtgtcacatggggtgacgtggcagggggtttctgcaggggtgcttctgagatagggcgatagggccagctggggttggctgcaggctccaggagttaggttccagatggatttcagatgggactttcttgctaaccctactttttttctgattataaaagtaataaagactccttgtagagaaggaggcaaaatacaaagaagagtgtgaagcccccatcactccattaatgttcaccagtcggggggtgggaggt

SEQ ID NO: 16878 - DNA, 1222 bp, Homo sapiens
gagcagctctgaccacagggtgcctgtgacctgtccccttgctccttgctctcagaatggtggtggagaatagtgtgtgtgcggggggtggtcttctcacctcctcttttctggcttgcagggggagatcggcccacccggtcccaggggagaagatggccctgaaggcccaaagggtcgcggaggtcccaatggtgaccccggtcctctgggaccccctggggagaaggtttgtgatgtgggacgttcagccactttcttgggagggatctgacaggcccttccccatggcctcgggctcccgttggctgtggctgccctaggcatggggtgggggtgattcctgagcgggctcctgtctccaccctgggttctctctgctgttcctatgaagctgttggttgaatgatgaccctttccttgtcccgggttcgccctttcccagccctccaccatcgccttggaaggctccttcctcccggtggctacaaagcctgcgttctgagccccaacattccaggaccccgtccttgtcacattcccgcctccacagctgggtaataacggtgtccccaccatggcctgaaggtgtggcagcctggcaggaaggaaggccggggtccttggagcaggctctgggcatgcagccatcaataggcctgcagtttccagctgtgggaggctcctgggccagccacacaccctggctccaccctgtttccaccctgggctcaggcaggaatggtgcatgcagtggtccagacttcctgccctatcctgctacgtggacccatacaaaagggctcagaggtgccccaggatgaacacgctgagttgaggcatttgcctctaatcgctttgctccacagtggcaagacctctcctccaggggccttcgcttcttcctcggtgcagggaccatcgggtaccccctggatttcatgggtgctggcagtcaccctccacctagggcaggcagggcttctgcataatgacgtgtgcccccgcctctggaaaccacaccctcctccaggcccctgccagaacgcatgtcctttctctctgctccggggaaacggatggagcaataccgtgctggccattaatgcaactctttcttcccccagggaaaactcggagtcccagggttaccagggtatccaggaagacaaggaccaaaggtaacttctggccgtgttaggtgtcccgggacaggcggagg

SEQ ID NO: 16879 - DNA, 1653 bp, Homo sapiens
tcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctatctgttttaaggtctccttgaaggcgcactggggaccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtcctttt

SEQ ID NO: 16880 - DNA, 1456 bp, Homo sapiens
gttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggccagttctcaccggggaaaaacccactgttaggatggcatgaacatttccttagatcgtggtcagctccgaggaatgtggcgtccaggctctttgagagccatgggctgcacccggccgtaggctagtgtaactcgcatcccattgcagtgccgtttcttgactgtgttgctgtctcttagattaaccgtgctgaggctccacatagctcctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggagatctttttgcttcacttgtcatttctgagagttttaaaaatgaccgagacttccaggtccttgcagacggattcctgggtttgagtggccctttgagaaagggaaataaatcctttctttcggaagagggcaaggacaggtccctgttggatctccaacctcccatccccccaacctggagaagcagcttagaatctacccgccacctcttaggtgactctggggcgctactccaacttggggctgtgcaccagggactccacccacaccccatctccaccctgctgtccctccatagacaccactggagggggcctggggcggcacccactttagtcagcactggcatggtgggcagagaccctgctgaggaaaagttcactcatctagggctgcagcaggcactggagataagtgacagccctctctgggacccgtatctccccaggc

SEQ ID NO: 16881 - DNA, 1221 bp, Homo sapiens
tgggaaaagagcaaaacagctgtgaggggcaggtgtcaggccgtcccatcccgcaggtgtggacacaggagctggcaccaaatgacctgccgccgtgtgcgaaaggcctgaagcagagctggtctcctggccggagctgccctggtcgcccccaagtcctagcctgtgcccccgccaccctggcagcagctgtgctcacactgtgggaactccaaagcccccactgcagagggaccagcatggcccccacctggctggccagcagcctccccgacttttcccttctcagggaccagggcagggctaccccaaggggagaggacgggcagagaggagggaatggcagcagccagggtggaggctccctggggtcccccgtcctgggtcacctttgttctctgtccttggagtcctggaacaggaatccaggagcttcccgtagacaccatcagatggataaactgaggccacagaccctttccagccagtgaacccagggccactgctgggatggtggcctctccctccctgtgcttggcagggctaccctgccggccccatggagactgtgagatgatgggggggctgtctctccaggaccgttctcaccctgtgggacacatgcccacgcccaccccatgagccggacgccaggctgtctcccatgaggggcagaggccatgttctcggagggatgagctgcggggtgggggtgctctgggctgatgccactcaggacttcagtctgaagcaaagggctgagcacagcgagtgggaatggcctgtccaggcccggggacagcggcagctgcagggccctgagggagggacagggctgagcagcctctggaggcgggggtgggggtgtgtggatgtggaggacggcatgcaggtgtgtatatgagtgagtgtgcaggggtctgtggataccataggcatgggttgctatgaagatctgtgcagacacacaaatgtgtgtggaatacagaggtgaatctgcaggtgtgtgcaggtgtagatgaaggcatgcatgcatgtgaggtgaacagacacgtcccggtgtctgcaggctgacgtacgtggcaggtgtgcgctggtgtgtgcaggtgtgctcagtgcctctgctcagggccacccctttgctgcgatgccacctagcaccagaggtgggtgcgggtcagagctggctcccagctgccctcctggctgtcccctgccctg

SEQ ID NO: 16882 - DNA, 2204 bp, Homo sapiens
gaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcct

SEQ ID NO: 16883 - DNA, 1169 bp, Homo sapiens
gttgatggtcagcctcgaggagcagcaatagcctggccagaaaaaaaaaccaggtgagtctgtgtttcagcagtgtttctgtttggaatgttttttatactaaacagcagttcttaagatgtcaccccaaccccctgaggatcaccgagacccttttatagggagtgcctgaaatcagaattatttttataacaacactaggaagttactgcctctctgcagcctcactcttgcgagtgtgccgtgggatttttcagaggctgcataccatgtggtgtggcagcaggtggagtcaggtatgagggtccagccagatcccagaactatacaggtgtcaaatagtgcctgcccttaacactaggaacttcttccgttctggcgaatatagtcatttgtcatggagtgggctaattactgtaattttaatcagtgtttagaaaatgtctgagctttaatttgtaggatgataaatagagattaatactgataaatagaaacaaaagctctttgaggtcctcagtaattttgaagggtatcaagaggtcctgggactagagtgtttgagaatcacaaagctgaaattatctctgattttcttctgctctgtggaagagtgagtttaaatctcctgcatatgagaggcgtattctctttgtgtggccggcattctcaccccctggtccatgttgggggtctttggtgtataccgcagcgcacccagtgggccttccctgtgtttcaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatc

SEQ ID NO: 16884 - DNA, 1239 bp, Homo sapiens
catgattctgctggatgaaccctacgtgcctactgaagtagcacgatggctgggctgcaccttccagccattagcctttttcttcctctgacgttattttctcttttgcaagcacatgtgtgactgaattcactcagttcagtgcacacaagatgcagcccgaccatctataaggtctcgcctttgaagggcagtgtgctgccttcccctgttccttcttccccctccagtggcaccagcccctggccatgcatttgttagctgggtgggtgggtgagtcaggccgcctggtatgcctccctcatctggatcttaagcattgagcttcctccctgttcctcagatggtcatgtttaacacatgggtacagactaagcactagacccttcccgcgtcagagctgacttcttgccttttggtacccagcccataccaagtttccgaagttttctttgctactgcaaagaatagtgttgtggaggtgactcgtgatcttccactttaatcatctgctaatacaacatgactatggccacgtacacttagaagactttgcttaccagaggctctcccgcctctgccgtgtaaacgccgtggggaagtgtgtgttacctcgtccacacgtggacctgctctgctgatgctcctctcctgccttccttctctcgcttcctgagcagtctccctccaagtggtattggaagttagtgcctgtaagtgaaccccaagccgccagctgccatctacagagccatcctgtcgcgatcacttgcttccattaaaaactgctcgcacccaaaactgtttttttgttgttgttgtttaaatgtcccaccttggagttatttatatagtacaagaattggcctgattctgagccgaataggccttgtaatatggcactttggaactcttaagttacatttcgcccagtttcctagttacttctttaagtgatcaacgtgcacgtaatgagagggcatttttgtgatagatacagagggaatgagaagtggtctagttgcccaagttactctgtatattttgttctttctgatgttaccttgcctgactgtggtatgtaatgtgacatctgttaggagccatcagctgggtggtccaggtatgcgggtgatgcacctggtggactagggctggagggctgcagagaggggctctcaccagcatgtcagattcctctgttctcctcctcgggtgttgcagccattcctgctgcct

SEQ ID NO: 16885 - DNA, 1232 bp, Homo sapiens
gattttcatgtcagaaagaggatgctgggctccctccccgggctgatgccagccctgcccacatgctgtctccgctggtgtccccaggcactacatggtcctagcctgtgctggtttcccctcagccccattaacacactcagggctcccatgtctaccttcttactgctgttaagttaggacagtcatcctttgaggtcacggtggaggtcacgaaatgatttcagttgtctgtgttcacagagtagtctgagatgctacagttagttgcctttgtaagtacagaagacagtagaattattgaaaagcctagagccttttcacgttgttagttgctcatttaatcaatcaatcaattattttttttgacacttggtctccctgtgttgcccaggctggagtacagtggcacagtcatagttcactgcagccttgaactccttcctttgggtcttgtgtgtggcactcacctggtcatcccctccctgtcttagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatggtgagtggtctgcggtggccgcccccaggggccatcctctggagccgtgggctctcgtgtggcgcacctggtgcatggatggtgtgaacacggtgtgcggcgaggtggtggagacccgtgcttttgcacactggcgttccttaggaaactgcatatcttttaaagcacatgactgttgtggagaatggggaaaagagagctttcattgagctctttttctcattgggaatgctctgtgaatgctgagattggagtgaggcctgttaataaaaatacttgaagcagactttttacagatgagaaatgtaattgttgcacccattctgttaggttgtttcatgcatactttgtgctaaaataactcagtctgcctttttctcccccaagtatcccacccccatctttctctgaagccttgctactggtgtgccttttccagagcgttctgggtcagggccattctcggtgcctcctg

SEQ ID NO: 16886 - DNA, 1280 bp, Homo sapiens
ggagttgttggggaagatgatttttgagccctggcggctgccagacagctgccgagagtgggggtgccatgagcacgcacaggcacactgcccacctgccagaattgagtgcatgactctctgtgatcagatctgatttgatgggtgcatccgatggagttgggtgggtttcagcctgagagtgcacacttagcagtgagctctgtgtggcctttgtattggagacgcaccctcttcattaggaagctgccgaagaggaaagtcacgcctgtgcctgtgggctgagtgggggcgtgggcactcaggctggctctgttttccctgcagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttcctatttcctgtcttcgtcttttcttggtgccgcacaagaaacccgtgcgtccccgagaggccacatccccgcggctccgtgccggctgctctgacccggggcgggcaccggggccaccgcagcatgtgggaggccttgtggccatgtttggttggcaaagcctcgtgttgtattgggtttaagggactggagctgagcccgtattcctgggacacaggtcctgagcccaagcacggctgcctccgcctacctctggcctcttcctccttttttttcattttaaaaaacatgaccggtgtcttaaaatgagaaaatgaatttattttgttttttgtgaactctgctcattattgttgctggaagcagtcagttccgagctgtttgttttgaacttctcttctgaaccagc

SEQ ID NO: 16887 - DNA, 1155 bp, Homo sapiens
cactggcttcagtcccacctgcagggaggctcttggccctgccaatcccctgccttgccctcagctgatcctgctgtcttgcaagaaagcaatgtcatctcaactctcagaatcaagagttctaggacaggggagcaagtcatagatccaagtaggtttggtggacatttagagaattgatctccttttttttcaccacagttccagacagaactccggaagatactggtgtctctcatcgaggtggcgcagaagctgttagcgctgaacccagatgcagtggaattgtttaagaaggcgaatggtatgagtcaaccccgatgctgcattccagggcggttcactgccggccttggggagcgtctgcagctccacgcactgaccactgaccggaacctcagtgctttatggaagcgctgatgagggcctggggcctgcctcaccggcaactcctgttgatgtgcctgagggcgggcaggtggagctcagacagataattgctgcaaatgtttgtgctcagataaggcccctgaacctgaggctggagccctcatggccctgtcgtctccctgcagcaatgctggacgaggacgaggatgagcgtgtggacgaggctgccctgcggcagctcacggagatgggctttccggagaacagagccaccaaggcccttcagctgaaccagtgcgtggggggccacctccttcccttgccggagacacctggggcctggttttgtggggctcccaccgtgggtgacgtcctcctaccctaaactctttgactgaatcatttctaacgtggggttttgaagaggtaccttaaatatgtgcctccaaagtgtttttggggtgaatgtgacagaacagtcgttgtgtaaattctctttgggccgttgtatgagaactcaaggtgaatcccgttcgtagcagggacacggcctctaacagtcttctcaggattcccgtgtgagttacttgccctgcttctgtgttcagatctaaaatgaataatccgagatccaggggcagccgggggcagttccccctgtggtccctatctaagccctcagcagatatctctgggtccgcttgcctctccttagacatgggcttctgattctgcccagggtctcaaggtagtctgaggcaagga

SEQ ID NO: 16888 - DNA, 1513 bp, Homo sapiens
aagtttattcacctgaaatactcctgtgtatttagttccttaggttgctgatttttggaactagttctcgagtctctaaaggactcagtaaggtcagctaagaagcctgtctgtgtgtcagactgacctcctgtctatacctgacatgatctgagggcttggcagaatttaggttgaaggaggctgcaattttctagtggcgactccatgtgataagttacgacgtatctgtgttgacaggttgagtgcgttacacttgagctgagtgtggtctctaaggataaacttcagttcttaccatagtagctgctcgcatacagtactttcgagttgcttttgtgagcatggttctgtggagttctggaactgtcagaggcaagcttggcaagcccccttctggaacgcactggctgtgaataactgggaggtgctggcctcaggattcacaccaaggagggggctgagcctcctgcgttcaagggccggtatgttttggctgctttcttgcttttcttctgccccagtctgcatgattttgccgtctgaacaaccatcggggcatcactaagctccagcgccggtaactccgtgggcatccaggctgtttgagccaggtggtgttgcttgtctagttgtgtgtattttaaaaaacttctctgggccgggcacggtaactcacacttgtaatcccagcactttgggaggccgaggtgggcggattatgaggtcaggagattgaggccatcttggccaacatggtgaaaccccgtctcaactaaaatacaaaaaattagcggggcgtggtggtgtgtgcctgtaatcccagctacttgggaggctgaggcagggtaatcgcttgaacccgggaggcggaggttgcagtgagatgagatcgcgccactgcactccagcctggcgacagagcaagactccgtctcaaaaaaaaaaaaaaaaaaaaaccagacaaaaaaccctagaaacttctctgaggtgctgctgtgtcctccctgagccagtacagaagctcctcaggggttcggtttatatccacaagtccagggccgggcttagagtggcaccaaaacaaacttgtgggttaatggaatagacaaaaatatcctgtggaccccacactgcatcgacatgggatgtcccctgcgttggcacggcatttactttaactcactcggtgcgatgtgcatggccatcatgatactcttttatgaaaggaaataggaaatgagagctgtttgatccacagatacctactcatgaatttcaggagcacggagggtcagttaggcagccagttccgatgcaatgctaattattatactcctgatatatattattccatttggtgttgagatgtatcatttgggatgttttgtcattattctactttaaattgagattgtatcccactctgcggtttccacaggtgtggaggatctgagtagcaggggattttcacaccgcaagagccgacatacatttcaggactccagagctg

SEQ ID NO: 16889 - DNA, 1182 bp, Homo sapiens
tagtaaaaactttttcagagtaaattttttattgtaaaaatatttggagatgtgcacagatcacatgtacccacccgatgaatttttacaaatgatcccacccagccgagcatcgcccagagtgtgatcagaccccgcaggccacaccctggggggctctgcctgtgagggacccggtggagctgcctggcctgctcctcgccgcgccctgggggggctctgcctgtgagtgacccagtggagccgcctggcctgctcctcgcagtgccgtgtcttgccatctgcctctgttgcctgtccctgtggcccacccatgcttgtgtcattgctgtgtggtctccagttgtgtgaatccagcgctgtctgtaccacgcctgtgggtggcattgggcacacccattgggattgcacatgttgctgccacctgcaccctgctgtctttgggccccaggctgggacggggctgctgtccctgggtgtatgcctgccccacgaggacagccgcacacacagctctgaccctggtgtgcttccggcaggacctgaccgagagctgcgaacagtcagacagacgatgattgacttcctgcagaaccacacggaaggaagccggccccctgcctgcccgcgcctagaccccattcagtgagtagctccatgaagaaggcggccgttagactcgtgttgaactgtgcaagaaacgtaataggtttctattaagtgatgtggccactgggatgtggtggccaactcgctgctgttgacggcactaaaagcctctttttttcctcttgaaaggcccagtgatgttctttcccttcttgacaaccgtggcagccattacgtggctattgtctttgaaagcaacagctcctaccttggacgggaggtacggcctctgcgtgggctccaggtgtcacacgtggtgtgattggggttggcggtggatctgtgatgagatttgcaggtgccggtcactgtgtcggcatctcgtgtcctgtctgtggctttaggtcttgttcattatcagaagcttagttaatgttactcagcaaagtcactggtgtctggagaagactgttaggatgaatgagcttggcggtgggaggggttcagaaggtggcctaaccctaggtttgaaactaagagggggctttgcagaagatctcatttttatgacac

SEQ ID NO: 16890 - DNA, 1241 bp, Homo sapiens
gctctgtgcacttctgactgtgcagtgcctcatgccgggaacagatgttacagtgagacaagctccatacgagccagccattgctgtcccccaagccagccaaggccgggcatgtttccacactcaccagtgggttcgttcagtcaacaggaggctgggatgaaacacttcaccttttgagagagagtatagttacaaaaatctgtatcagaagtggctccattttgactcaagctgtgtgtagctgtgagtcctgcctaccaagcattcacactgtaagacaggaaaagagaaaggggaaaagtgtctgctgttccccgatgaagggtaggaggtgtcccctggcacgcaaagcccaagcgtccctgaaatgtctgctgggccccaacaaaaggtaggtgcccctggcatgcaaagcccaagtgtcccctggctgttgagcagagtgtgagctcagggcctggcattgtccacctggcacgcaaagcccgagcgtcccctggctgttaagcagagtgtgagttcagggcctggcattatgggcttgtgttttcttccagagacaccaccatgtatgctgtgtctgctgatagcaaaggcttggacacggtggttgccttactggctgatgtggttctgcagccccggctaacaggtgtggatcccagccgctggcgtttgaggtgggcttggacatagggaagaccggaaaggtttgcagaagccctgtagccatgagggagagcaccatgtaattggagctttaggccaacacaaagtgacagcgagatctcataagaaatagcgctggggctgggcatggtggctcacacctggaatcccaggactttgggaggctcaggcaggcaaatcgcttgagcccaggagtttgagaccagcctgggcaacatggtgaaaccctgtctctacaaaaaagatacaagaattagctggctgtggttgcttacacttagagtcctagctactcgggaggctgaggtaggaagatcgtttgagcctgggaggttgaggctgcagtgagccatgattgtgccactgccctccagcctgggcaacagagtgaggctttgtctcaaaaaaagaaagaaaggaaaaagaaatagtgctagtagccaggcgtgctggctcacgcctgtaatcccggcatttagggatgtagagatgggaggatcacttcagcccaggagttcgagaccagtctgagcaacatagcaagactc

SEQ ID NO: 16891 - DNA, 1882 bp, Homo sapiens
ccccgcgtcccatgcagtaggccaggcctggccaccacttgtccctggactctggacagccaggctggctctgcagagcagctccaggtctcatggccctgatgaaaccacggcacctcctggccaccctcacagtaaacattgatggttaaggatacagtgctttcaagggagcccaggacttggcactgacttgtcggtttccagaggcttttggaaacaaaaacgaagccttcagcttgtcagcgccaatggcccgtgtggttcattatgtggaccagcccctgccacgctgcagccgagcactgctcaccctgggggcaggcatgcagaggtcatgctgttgatttcattccaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacaggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccttagttactgcagtgaatttctttcctgttgcaaagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgac

SEQ ID NO: 16892 - DNA, 1181 bp, Homo sapiens
tcctctgacgcagtgagcgcagagcatttggaagctggaggccacctggcgcgttcacctcaatttgcttccctcccctttgcagcaggaaccagagctcgctacgttgacgtcctgaacccaagcgggacccagcggagcgagccggctctcgctcctgcggactttgtcgctccactcgcgccactcccaattccttctaacttgttcgtgccaaccccaggtaggtagcacgagcaccagcccctccaggtcagcccccagtctcctgacctttgatcctctttctatgagtctctcctaaatctcccgttaaaagaatgacctggccagcatgcagagagcctggggttggtttgtggttttttttttgatttgcctgtttctgcatgagtgtgccgcgtgtgcagtgtgaaactctcttcctctcggagtgtcttcagtgagaccccagggacgttcgggacggaatgatggcctcctcgctctctcatccccagatgcagaagaaccacagcttccagacgggactggcagggaagggcctgcagcagctaggggcctggccaatccagagcctgccccagagcccaaggtgagcgggtacggtgggaaaggggaaaggtacccagtgaggaggcacctccccatcctgccagacagggccttgccttctgcaagtcagtatccaatgtgtacgtagagtgttccgccttaaacgcctcacacttatgtatggtagagacggaaggtagaatgcagggtgccgggcgggacagagctgtttgggaagacggagatctggggatagtggcggtgatggttgctcagcacggtgaatgtgcttaaaacttaaaaatgattaaagtggcaaattttacagtatgtatattttacaatttttaaaattggaaaaagtaaaattaattactctaagttacagagaaattacctaccgataataaaagttaagtatattttcatccaaaaaaaaaaaacaaaaaacaaatgactcccatgtgaagtagaacagctcagaccagtcgggagtggtggatgatgcctgtaatcccagctctttgggaggctgagctgggcgggtcacctgaggtcaggagttcgagaccagcctggccaacatggtgaaaccccatctctactaaaaaaaaaacaaaatttac

SEQ ID NO: 16893 - DNA, 1564 bp, Homo sapiens
ttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagacttggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtgatctggcttccactcccctctgctctggcctttggctccctttctgggagggaggcagggctgctatgctctgagggagccaggagtcgagggccccttctgctgggagagtgacggtgaggctgcctagtcctggcccacgggggtgtggggaccacgctgcctccagggactccatggtgtctgcagcctgcctggtccaggccctttgt

SEQ ID NO: 16894 - DNA, 1130 bp, Homo sapiens
tgggtgggtttcagaagatgtatcaaagccttaacatttaacaagagtcaggctaggtggttgcaggacgctggggtggggtcctgaggagcagcctgcctgcccccaccccgcggaggaggttgtactgctgcttcctctggtgatggaaccttggggagggtccccacgcctggcctggcccccctcaccggcccccgccctcatcccccaggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctacc

SEQ ID NO: 16895 - DNA, 1653 bp, Homo sapiens
acagcgggcaagtggtggggggcttttcgcagcaccctactgccctgcacttggcatggtcccctcgctaatgaaccaaacccctgccgcagtcttgggtatgggaagcgctgcggcccccacttttttctttattttgagacagagccttgctctgttgtccaggctggagtgcaatggcatgatctcagctcactgcaacctccacccctcaggttcaagtgattcccctgcctcagcctcccgagtagctgagattacaggcatgtgccaccacacctggctaatttttgtatttttagtatatatggggtgggggagtttcgccatgttggccaggctgatcttgaactcctggcctcaagtgactcagccacccccgcctcccaaagtgctgggattacaggtgtgagccacagcgcccagcctgcccccactaaaggactctgcgagtctgagtggatgggcacctccgccagcccatagggcattgcagacccgggagtgcccaggccccggccgtgctgctcgggcctccctcgacctgcagtgtggtcccccttgcaggtacaagtgcgactgtgaccctgggtggagtgggaccaactgtgacatcaacaacaatgagtgtgaatccaacccttgtgtcaacggcggcacctgcaaagacatgaccagtggctacgtgtgcacctgccgggagggcttcagcggtgagtgggctgcgcgtttctcagtgcagagggccgccctcgagtctggggagctggagacacaggatcgggacccaggtccagccagcaccatgcatggtgtctccctcccgtggcaaagccttagctccaggcctctggctcttggagatgaggaggggcctggggtggggagcaggcccagggctgctgttgtggggccctgccaaggtgcctgggagtgctggacatgccgagtgctgtccccttccctccaggtcccaactgccagaccaacatcaacgagtgtgcgtccaacccatgtctgaaccagggcacgtgtattgacgacgttgccgggtacaagtgcaactgcctgctgccctacacaggtgaggggtgggtggggcctgtgctggagggggcggggcctatgtgggaggggcgggacctgtgctggagagggcggagcctgtgctggagagggtggggccaggggtgggggcggcctgggaagccgtgactggagggtaaagtggtggctttcttggggcggggccttccagaaggttctgcgcctcactgagtgccttaggcccctgcagtatgtgggccttctcccgggggtggggttggcagattagcaaagatacaggatgcctgggagaaaattttcatgcaagcatgtgttttacctggcaagcctgccgcaagacacaggtaagatgcaggtgaatccttagcagggccgggcctgggtcactgggctccgtgctcccggcgcccaccctgctggggtctctgggggccgggcttccccacccccgccagccggacctgagggattcctttgatggcgggctctctttgtgtgagcggaacaaggagccctctgtttgggctgagcggggagggggatgttcccccaactgtccagcccctgctatgaacccagccaagg

SEQ ID NO: 16896 - DNA, 1117 bp, Homo sapiens
ctcggagccctcctcaggttggcacaggtgaccccaggtctggtcatgggtgtcccgggggccgccagtcctaagtcttcctgtgcccgcccctcccacggtccagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgccacgggggcacctgccaggaccgcgacaacgcctacctctgcttctgcctgaaggggaccacaggtggccggccaggcgggtggccggcggggggccagtgggcagggcgggcctgaggactgaccgacacgtgccaccccttcaggacccaactgcgagatcaacctggatgactgtgccagcagcccctgcgactcgggcacctgtctggacaagatcgatggctacgagtgtgcctgtgagccgggctacacaggtgagcggccctgcacgtgggggctgactgcactgtgctcagaggtcaaggtcagccactctgccctggggctgctgaggggttgggtgagggctttggtgctgcccacctgggcagaccgtggtctgcagcagagattgcagcgggaccagggctataactggcagcacgatgggtccccccgacccctcttgtctccggtcagagctgtcccaggccgtgttggcagagtggcccagcaggccaagagggagcagccagccctgaggccaggcttaagtaccttctgcctctgtggctcaccagcacctttgagcaggtccctctgcctctctgggcctcagattctcatcagtcagggctgcagtagcccctgcccctggggcccctgggaggatgacttgagtgggcactggtgcccggggaggctggcacatggcacattgtgatccaagatggtttctgacacctggaaggatgtggccagaagggtgatcgccccggctcaacagacagggaaatcgaggttgacgtgggtgggaccccctgggcgctgggcctcggagtctgacccgccctgccct

SEQ ID NO: 16897 - DNA, 1232 bp, Homo sapiens
ccatggctctccgcgggtgtagacccagacccctgcccgggctgtggagtccaagctgggttctgctggaacatcctagtctctagcttgttccccaagttagcagtcatttgtcttcttctttctttctttttttgagtcttgctctgtcacccaggctggagtgcagtggcgtgatctcggctcactgcaacctctgcctcctgggttcaagtgattctcctgcttcagcctcattcagtggcattcagtacattcccaaagttgtgcaatcgcggcatgtgtctggttccagaacattttatcagccctaagggaaccccgctaagcagccgttgtgcccgtgcccggggtgtggggggaggcggctgtgcccatgacaggttcccggtgctgagtggcgggggcgctggggaagcaggtgggaactaactgccctggcacatctgccaacagctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaatgcctgcctcaccaacccctgccgcaacgggggcacctgcgacctgctcacgctgacggagtacaagtgccgctgcccgcccggctggtcaggtgagggaggacccacagcctgaggggtgggcagacccaggcccgccgccagctgcccaggcaacttgaggtacttggcgggatccaggcccgggtctctgacccggaagtaattgggagcccctgccccagggtccctgcccccctcccagacctggaatcgcctcgttttcagctgcttgctctggcccaactcttgctgtccccgcttctgcgagacaaggggagcctctgtgtccaggccgcccctgcccccttcctcctgccgtgcactggccctcacctgttagggtgaagggtgtctggaggtgtcagctctgggaagagacggcccaggctcaggcctcttgggagctgtggtccttcatctgccaaaggcgaccggtctcacggcaggtcctgaggatcaaatgtgatagcacctaaggtggagcccaggctggcacctccaggtggcctgaagggagggaaggcccggcctcggggagcagtgaggccagcacgaccctcttg

SEQ ID NO: 16898 - DNA, 1196 bp, Homo sapiens
atgtttgatagtctcacactcctgttttgtggacaggcatctgttttccttcgctggtatctgggagagagggtgggccctgtgagtgggctttctaactctcgcgctgggctaggctggcctctaggggtctgaagggatagtgggaaggtggagggtgccttcaccaggagcagccttcatgagtgagttttaagaacctgtgaggatcggtcaggtcaggtgaggtacgcgctggatcatgccgtacaccgtgtcaggatcacgcaggacaggactggggaagggtttgctggcgtctcggttaatagcagtaacggcagccgcttgtgttcttgattctttgccaagcattcttgttatttaacacgggaaggaggtgacttcgcctgtgatggacttccagtgtgagcactggccagagtgaccaggctgaccagcaccagccctgatccaggtaagaggtgaggcggaggcttgccctccttccctgcctgccgggtgcgtgtgagcggctgccctgcggatgctgtcctggacctgttggcaccacagacagttgctctgctgtgcctgtggcctcggggcaaagagaaagtggcgatttctacactcagtgctcgggaaccagtgggcactgagaatggtttatggcctgacattacttgcaaccaaagccaggcagcatttggattttcgcttttggaaaccaccttacctggtttgctccatgagggaggggcagcaacatcgctgggaaccctgaggtgtagatatgtataaatgagctgtgtgtgtatctgaagctcgggcacttgtggggttaccaggagtgtgcgtctcactcccaggcctcgttctggaaacgattctgtaggtctgtctgggaggccttaggcaagtttgattaagaacagtcgagctggataaacaggctgttccttgtccagcactagtcatcccaggggggcgggggcggggctgcaactcctgtgcacaaaggaagggccctgggtaggggtcaggagctgccttgcccagagatgtgtctgggtcactttggaaacaggaatcctctccccaaaatgggtagcaatgggggtacagaggccaaagacgcagctgcatgtcctgcagtgcctgggacgccccgtagtgaagagtgatgtggcccaaatgtcagcagtgccagtgtc

SEQ ID NO: 16899 - DNA, 1196 bp, Homo sapiens; identical to SEQ ID NO: 16898

SEQ ID NO: 16900 - DNA, 1196 bp, Homo sapiens; identical to SEQ ID NO: 16898

SEQ ID NO: 16901 - DNA, 1169 bp, Homo sapiens
gaccctctgcttgtccacaaaggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggtaagacgagtcctcccggggcagaggtcagccaggtggccagggtccctcccacaggcctgatctgggtgggtgcagtgggaggaggcttctggaagaggcatctcatgtccccacacttgggccttgccggcctggtttgagatcccacaacccctgggggtgtgggagggatgatggcctgaccagttgctctccctgctccaggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtgggtgggggcaccagagtgcggtcagcctgctggagtttgggtagaacgtgggcctcctcccagctgctggccgctggccggggtcctctcctgagtccaggatgctgtgccatgctcctggcagccccctgcaggagctgatgtttgcagtgtggtcctgtccatcagcagggcctcctggagggctggggctcgctgctttgtgagtttctagagaagtcctgtcacccagcttggggtccccgttggcctgagtttgagccactgtctgtcctgtctgtgcaggtaaggagggcaaaaccccctctaaggagaagaagaagaagaagaaaaaaggcaaagaggtactggctactccccttcctggcaggccaggactgggtggcatgcggtcctgggaccagggctgtggcttcctgtgactccatggcgccccatccttgtgctcctcaggaagaagaaaaagctgccaagaagaagagcaaacacaagaagagcaa

SEQ ID NO: 16902 - DNA, 1210 bp, Homo sapiens
gctttgcttctccaggtagtacagactgagggatggtggggtctctgcaggcctcaggaaacccctaagagcaagtggagtccgagtcccttccccttgccagttcccgtcagcctgtgctgttggcgatggttctctgagcctgagcacagcgggtccgggccctgtcagcatggggccggaagccagttccacagaggaccccggctccggttcttccggagaggggtgttcatgctctgctgtctaaggtgatcagactcatcctcttcaaaattagatgtgggaaccaggagtgctcgtgtgctgagagcccagtgaggcacgggagcggcgtggccccccttccctgggaagatgttgaagaggggcagcgttggggggaggagggagctggtgctgcagtggccagtggctgtggctcatttcaggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgctgggttctgctggctgtttttctccctacatcgcgttcctcagatcagggtgcagaactccaccttcctgtcctggggtgtctgcccagtagcggttgtggctcagaggcctcggggagctctgagcaccaccttatacaagggtgaggggtggaggcctgaggcgtggaaggaagaggagcggtgtcactgggcgctgctttctttgatgcagctctgaagagaagctgggaaaagttcctgcccttggcgctggggccagattgtccggtcctgctctcagctcccaggcccctagttgtggggaaagctggtgaattttcatgactgatgcccgggagtgggctgccggggggagctctgaaggtctctgcagggccatttcctcttcgcccatctgcgtggacagttggtgggcactggtcagccccacggcacctgaagacgagggacggcggtagccgtgcccaactgccgccctccgctgggacttagtccccagggcggatgggagcctagcggctggcaagggtgctgtgctgtgccctcca

SEQ ID NO: 16903 - DNA, 1207 bp, Homo sapiens
tcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagcacattgttgtccagtctctgtctgcagggagggagactgtgggcactgctggcacagtggagtggacctcatggtcactgctgacgggtgacgctgttattgctggcacagtggtcctactggagtgaatgttgcagtcactgctgacaggtgacatgtgcgtctgaggtcatgtgctggtgccagactttgtcacactgccctgtcctccatgacctccagggagatgcctggcacatgtgccggggctggcagcatgcagggcctgccgtctgggtccagggtcagtaggccacgtcactcccagtgccagggcagcccccccagtcagtcccgtccttgagggagttcctcagctgctgggtccagagtcggcaggctgcgtcgctcccagtgccagggcagcccccacagtcagtcccatccttaagggagttcctcggctgctgggtccagagttggcaggctgcgtcactcccagtgccagggcggccccccacagtcccgtccttgagggagtccctcggctgctgggtccagagtcggcaggc

SEQ ID NO: 16904 - DNA, 1231 bp, Homo sapiens
taacttcttacgattagagttaggaagcttccggtttgtgtgtgaagacgatggaagggcggggctccaggatgtatccgcagagccacggagggaacctggactcggctggacttggagccggggcgggggcgggagggggcgaggttcgagtggggctgctcgcgggcgcgagggccagagcccgggatcgcgccgtggagcccacgaccggcgaggccagcgctgggggcagggcctctggatccctgacccaggacgccctgctccggcccgccccgcgcactaaactcggcctctagtcgcctgaagcccgcgcgggtaccgggtccgcgcggcccggcctgtgcctttagccccgccccgaatccccccaccctcataaccccgcccctaaccccgcctccacacacagaccccgcccccaaccagactccgccccgcgcaagctccctaagcccgcgactggcctgcacccggctccggaagtcgttcttccgcgcaggagccctgagcccgcacagccccgcccctcccggcgcccaagccccgccccgccgggttcccgctcgcccggcgccatggatccgctgtcgccgccgctctgcacgctgccgccgggccccgagccgccccgcttcgtgtgctactgcgaaggggaggaaagcggggagggggaccgcggcggcttcaacctctagtgagtgggggtccgcggggaggtaggggtgcagggagctccgcgggcggccccgcctgacaggccttctcccccagcgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctctggggtcgggcaggtttcgggtgcccccagtgggcctcgggttccaggcagctcgtgacaagcccctgtgctctctagaaagcccgttttggcctgagtgcggctgaggacatcaccccccggttcaggtgagacccaagcagggaggaaggacgggtggggaggaggagggtctgccacagctctccgcacctctcctctcccagggcagcctgtgagcagcaagctgtggctctgactctgcagg

SEQ ID NO: 16905 - DNA, 1204 bp, Homo sapiens
ggaggggggagcggcctcaggtgggaccggggctgcctggtgaccactgcccgccacctgcccgcaggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggtggggcggtgacgacatggtgggggtggcggaccctgcggaggctgtgcccctcaccccggccacccctgtgcccctgaccccggccaccccgcaggacctgaaggttgtcaacagttacctgaaaagctgcttcctcattttccccaactacaacctgggccacgggctcatggagatggcctacaacgagtacatcaacgagtactacgccaagattggtgagggggcccgtggggcggggaaggcggtgggggccccgcaaggcccagagcacaggccctgagctgtctccccgcaggccagtttgacaagatgaagtccccgttcgagtgggacattgtcacccgcggactggtggccatggcggttgagggcgtcgtgggcttcctcctgaccatcatgtgccagtacaacttcctgcggcggccacagtgagtggggggcggggtggggcgggggcggggcgggagcagggatgggttcgggggtggggcagggtaggggcgggggtgggggcagggatggggcaggagggggtgaggcaggggacagcagaggggcctgcccacccttcttacatgccacagccagaggatgcgaggctggtggcagggaggggcagtgggggtggcgagctgctggacactgtccaccctgtcccccaaggcgcatgcctgtgtctaccaagcctgtggaggatgatgtggacgtggccagtgagcggcagcgagtgctccggggagacgccgacaatgacatggtcaagattgagaacctgaccaaggtgggctctgggcatgtagggtggggcctgggtggggtaggccagggccaggggggtggggccccagcagtggaggtggagcctgggtgggcagggccctgagctctgggggtggggcctgcatggggtggggctgtggggcacgtggccccctgggctctggaggtggggcagggtctgggtggggtggggccagaggggc

SEQ ID NO: 16906 - DNA, 1098 bp, Homo sapiens
ggaagtacagtcagctctggacatctctctccctacctgggcttgactcccctggagggatggcccagggtcaggcagagggaggtcaagaggtcgtttagggcagctatggtggctgcccagcccgcctcacgaggttgctgctgcaagccagtctggcttcccagctgtgtgctcaccacaggcagacttcgggagggtgggctcagctgaagggtccgtcacccctcccccagggaagcctgagtggaggggctaagaaaggccaagacccctcagcaggaggaacggggctcctgctccaaatgggcctatggggctcacacatgcaggtgtcagcagaagcgtgcgtccgtgggtgtttgcaaacgtgtacacgtgctgctgcatttgtgtctgtggctctggtgcccacccacaggtgagctcatgcatgtgtggacgtgtgcgtgctcactggggccaggcattccatgtaaatgcacgtattgcagctgaagcagatgaaggagctggagcaggagaaggaggtgctgctgcagggtttggagatgatggcgcggggccgcgactggtaccagcagcagctgcaacgagtgcaggagcgccagcgccgcctgggccagagcagagccagcgccgtgagtgccacagccctgtccccagatccccacacatggggaccccagctcaccccaggcacccttgggcattgtggctgcccctattcccggacacagtggctgtcgattccacccaggatgctgagacatccctttctccgcctgtggctgccccactcctagggcctaaggtgtcttgggcagacctcccacctcagcaatgcccctgggaccctctaggctctctgcagcatcaggaggcaggagagccacctgtgggaacccctatcaaggcaccttgctggccccggctggacctcctctctgaccgcttgtcctctgctttcttcccaggactttggggctgcagggagcccccgcccactggggcggctactgcccaaggtacaagaggtggcccggtgcctgggggagctgctggctgcagcctgtgccagccgggtgagtgtacccc

SEQ ID NO: 16907 - DNA, 1184 bp, Homo sapiens
cgccggagccacgagccgcgctgctggcggagctggcgctgctggagcccgaggcgctgcgcgagcactgccggcgggcggcggaggcctgcgcgcgcccccacggcccgccgcccgacttggccgcgcgcctgcggcccctgcccccagagcgcgtgggcagggccagccgcagcgaccccgagacacggcggcgctgggaggaggaaggtaagcggggtgggaggccctgggggccggcagggggtcgtgcccacggagcgggtgggaaccgaggccgcgctcggggaactgtagttctcctcgctactttgagacgtgtctcgcctcacgcgttccggcccccgagtcctggcgccccagccccagagttggtttcccctaaagcggaagggtgggcgggtcccgggcgtcccttcacggcgcccgtacccccaggtttccgtcagatttctctgaacaaggtggccgtcctgctgctggctggggggcagggcactcgcctgggcgtgacctaccccaagggtatgtaccgtgtggggctgcccagccggaagaccctgtaccagctgcaggcggagcggattcggcgggtggagcagctggccggtgagcgccacgggacccgctgcaccgtcccctggtgtgtcctgcctgccctacctcggcccggaggtacccttccccacgcccccccacatccccgctccagacgcgagccccaaccccggcacagaccgggacattgcccagaaccggcccaaaatggggcctggccccagccccaactggacactggaccccgaaccccgatgccggctctggtccgagccccgtctgcctgcagggccaggcgtactcgcggccggctcaccgcgcctcccttgcaggtacgtcatgaccagcgagttcactctggggcccacggccgagttcttcagggagcacaacttcttccacctggaccccgccaacgtggtcatgtttgagcagcgcctgctgcctgctgtgacctttgatggcaaggttatcctggagcggaaagacaaagttgccatggccccaggtgtggcccgttcctgagacggggagggaccgcccagactagaactgggagcgtagttgggggtccacgcgcccgggttcgcggctgccccgaggctgtgtggtcctgggttaggcgc

SEQ ID NO: 16908 - DNA, 1496 bp, Homo sapiens
tgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaccgcgatgtcgcctgtgtctttagggatctccatgactggaaagtctgggcggacgttggggagaaggtattcttcaagtcacgtctcagaattcggtttgctgagactggactctagctgtcccctgctggtgggcagggagaggccacggggaagctccgtgtccctggccccacggggcagatgcttggcgggaggcatccttgcgcctgcgtttcacacagggcctgtttccctgcagggctggcactgaggcgcacagctgagggatacacgggccctcaggtcaggcagctcccagcagcctggcatggctatggccccgagccctgggctgtggtggcagagttgtcctcatcatcactctactgctgtccctatcccagggctgaccctgggccttggctgggttccccccgaccctgaaccaggtgacctcttaggaccacgccccctcgctctcccctgtgaaaaatccatcaccttcacttccggaagactccccttccctgggaagccagagccggtggcggcacagggcagggctacccggacccagcccaggattgccagctccgcccctcgggacgtccgggccccgagtgtgggcctcggctctgcctgtccccacaacccccaacatcccacagcagccacctgtgtccctctggggacagtgggcaccctggggcttcgtctcccacttcatgctgggccctgatcctgcactccaccctctgtgcctggaaaggtgagaacatcggctgtcatgtgaccctggcgcctgccccttgtcacggtgggcccagcacggccctagcctgccccttgtcagtaccaccctagcccgccccttgtcacggtgggcccagtgctgccctcctggaccaggtgccccatggccggctgaacgggcagg

SEQ ID NO: 16909 - DNA, 2896 bp, Homo sapiens
tatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaaggtaagttgccggggcgctggggccaggcgggcctgccgggcggtgtgggcgggcggccggggaagatggcggcagcagcggccgggcggcgcccccgcattgcggccgccgggccccctccgcggggaattggccgagccgggcgaccgaagcccccaggaacccggcggccagggcgcgcggggcgggggaggggcggggagggccgggctgccgcgcccgtccggggcggggctgcctccctgcgcaccggccgcggtgactcagccccggcccgcccgggcccgcccgcgtcccttgtagttttgggaggtgatcagcgatgagcacggcatcgaccccacgggcacctaccacggggacagcgacctgcagctggaacgcatcaacgtgtactacaatgaggccaccggtgaggccccggccccttccccgaccgccctccggggaccccgcggcccctgccttggctgacgccctcccgtccccgcaggcggcaagtacgtgccccgcgccgtgctcgtggatctggagcccggcaccatggactccgtgcgctcggggcccttcgggcagatcttccggccggacaacttcgttttcggtgagccgtggctggggactgggcggcggctcaaaggtcaaggggctgctccaagggcaccgccgtgggaactgcgcagccggggcccctggacgccctcctcttctctgagccactcaatcccctctactaaatcggctttgggagcaaggtccagctgtctgccgaggcgaggagccgccacacacgtaatctccctgcagggagctgagctggggcagtggctgttcctctgtccttgggaattggcagtggcccccccggggaggggtttgttaagctgtcaggtttggcccctgacttaattcgtagcagggcaggctgccgtcttttggctttgaagggtccgtttgctctacctccagggtgaattctgtggtcagctcacaccatgtcactcggcttttttcgcatggcggtgaccagtagtgctgtctacctggctgacaaatgattagctgtgttctctcacaggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgtgtggtttcgctttgcccattccttccagtaggccctccgggtgctgttgccgaatgtcagggcgtagttgtcctgcatggctgcggggagccaggctgcagctgagctgggcttatgtgcccaggaccagcatgggctggacacccaggcttcagagaagtgtggggctgccctgggccctgggtatctgcttggtggggaacttgcttgttgaaggcaggcctgtcctgttccaggtacccaaccttggggctcggcctgtgtctgggacttaggtgggtccagtgaccccccttccaaaaggggtagggaggatggcagacaatcctaccccaaccaaggtgggaccctggtaatggtcagacaggtggtcctgaaccagcaatgaagggtgagcaggtagagccgtccctccccacattggccggggtgtgtccatgtgacc

SEQ ID NO: 16910 - DNA, 2162 bp, Homo sapiens
tagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcatctggcctctcggacattctctgctccgcctccctcttgtgctgcttagggtgaggtcattttgagtggagccgagtccttgtgggtgaggcaggaggacccttgttcctggtgggcccttctgaggagcgggtgagctcagaccttcctgagtccagcagggagtatgagtgagactctgtccttgtcttgcggcaggagtggtggggttgctaagtcagctgcccgctgttttatggggagtaggatgctctcgcccctgacattggttagttcttgcctgatttatgcatgaagtggctgggagctcagcagtgagcttctgcccagaagaatccacagggcatgttcagcaggcctgctgcagatggtggagggggctggccagccagggtgaggtgagggtctcacttctccgtccgtctgcagggctgtggtttccaggatagccctccctctccttggggagccccaggtgtctggggctggtcagcatcttgtacccatagagctgccccagggaaacatgccaggctgtgtggctgggatcctgcctgtctccaggtgcgcccagccagaggccttgcttcttgggagctggaagcctggccagtccgactctgacctgtctggtctggtccggtccgaccctgtgttggtcccacaggttgctgctacactttcccttcttgaagctccactgccatgttccaggacaccctgtgtgttctcattgctgcccctggctgggctggcttttgtctgtaagcaaaacttccagtaccttttctggcagtaccctgggggctcctgaagaacaggactgctgaaaatgggtgatatcaacaaactccgcaggatttcctggagcttagagaactgcatgtgcccacatcaggccctgagaagcccccttagctgctgcaaaggttggggacattttttgctgagtaggtgaaagctgccagggagggggacatatgtgtccctagagatggcgggtcagcaggttggggtttggggcagtcttcaggcctggagccccgagtgccctcaggcagcctgctttcagatagagtctgaggatgagcacggagtgcaggggtcccctttacctgcatccaggggtgtggccatgttgcccctgaccagcagggctgctttgtttggcagtcattcatcagaaaagtgcactgaaagaagcgcccagggcctcccacctgtgagacaccacgctggggaagggggcggtgcaggttctaggtttgcatgtggcagctcctccaggcctcaccccagcaggtggcaccgtgagggtgggacgggccccaccactgcttccctctcacctgatacccaatcctctggtcatctttcccgttccgtggccccgacttcttggtcttcgtagccaggtatctaagacgtcctgtgaggacatccagatggctgcaatgtggggctgcttctaaagcttgtttggagtgtggtgtgttgggatgcgcacctggtcactctccctcccccgcagaggtgtgtggttgaggcccttttggaatgccctgctgccttcctggccagccttttctgcgcctctgtctctgtggtggtctgagctgttggctctctgccatgtctttagccacagccctgcttgaagccctgaggctgaatacccaggcacccgtatatttcagtcaagtccgccttagcttcctggagctgccgcaacaaagcagcgcgagctgtgcagcctgaagcagcgggaattcacagtctaggctctggaggccggagtctcagatgaaggcgcaggcaagggccctcaggtgcggacgcctcctccctgccaggtgccttgcctgcctccctgtgctctgcacagcaatggccctgcaagtcttctgcatcagctttctcttctgcggactcctgctcctctgggtcagggcccacgcctgctgcttctgagagcccctgtttgttaaggatgctctctgagg

SEQ ID NO: 16911 - DNA, 1172 bp, Homo sapiens
gcttgctcactggccttcccaggaccctgcccaggtggtgctgcttggccccaggtcgaattcctgtgctggcagcaagcaggggcctgggccgtcggctggctggggctcatgcagccatcccctttgcagccatccgggtgacctgcataggttcctgcggggtctccaacaaggctaatgacacagcgtgggtagtggaggagggttacttcaacagttccctgtcgctggcagacaagggtaagtttgggagccagttcccgagtggtgacccctgggggcagcccttggagtggggcctgtctgtcctgtcctccccctttcctagatctgcctcttggatctggcactggcccatcttgtcccagggttgtgggccctgatggctttctcataggcgctgggtggctgaaggggccacctcccccttgtgctggatttgggtgggctctgacccctggcacagctgtttcacccttgccccattcccaaaccactctcctgttcaagccaagctcttatcctcagtccttcacccaagccacagccctgtgctgctgtggcgctggtgactgagacagggagacccagtgtgagctggtcagctgcagtgcccactcttatcctggccctgtggccacctcaggccacctcagggggggactgccccccacctccctcctgtctctgcagggagcctgcccgctggagagcacagcttccccttccagttcctgcttcctggtgagagcccagcctggacaggcctggtgatgaccaactggtcctgggaggtgggctctgcagggtggaaggcagccaggtaccagtgcctgctctctccccagccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggtgaggatggcacagtgacctccttggtgggtccccaccctcatggaggctggggaagagctgggcaggcactgcttcatcccagcgtcctgtccccagctgaggtgaggggggccagggtctggaggcagtggcctctttgccctgagctgactgctgatgtcca

SEQ ID NO: 16912 - DNA, 1327 bp, Homo sapiens
agatcactgagactgagtaaaataccattttaacacacaacatagttacctactgtgggataaatgccatttggggatgttgcaaactgtagccatggtaaactgggaaagcaggttttgagaggttttgatgctgcccattttgggtattttttagcttagtaagtgtattatctaagtcaggggttggaacatttttttctgcaaagaaccagctagaaaatgtttcaggttttgtggaccacatgtggtcactgttcctcctccctcctgctcattcctccttctggcctttagccctgtaaatgctgttcttagcttgggccatggtttgtagatgctgacctaacccatctgaggggcaactaggcacacgtgaggacagctgtgctgtttccgcttgcagactttctcctctctccattgtatctcatctttcggttgtggggaattatcggggagaagaactgtgattttggttgcatgttatttcagtgaccacctgcttatgcagttatagttattcactgtctttgttttgaagcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacaggtaaagaggacccggcaactgtctctgctctttgaatgtatgtttcgagcctgccccttgccaggtgagagttctgtttggctgtaagtgcctgtgctgctcttgatgaatgactgttgacgtcagctggccctcctgtgctcgcctgtatgcctgaggaggcacacctgacctctgctctaagccttgtctcatgccagcattgatttcctagcttgttaacattctcaagatgaagactgttttctttactagtatgtgactcacttggtctatgtggggagaagaccctggagttggaagctttcctggtttgtaggtggagtgcctttggaaatgctggggtgtgctggggaagtctgtggcccagggtgaggaccaccgcccgctccagctgctctgccaccagccacctcgctccaggcgtgctcctcactctcctgggctggctgcttctatggccagttccgggagtggatgaacgtttgattccttaccggggaccttttgtgggaggtgctgggagggcaccgggacctcagagtgagcgctgcgtcagggctccctgggctttcaaacctcctcagcttctgggatgggat

SEQ ID NO: 16913 - DNA, 1203 bp, Homo sapiens
tttttttttttttttagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaaggtaagagacgcatttgagtgagttgccacgtgtgcgtggaaatgcgtttctgtgttcagggcctcgttatcagtaatttgggtgacctcagtccccgggaaggtgccagtgccatgaagctcctctgccataggggcagagtgttcgtgtccaagatcattgtgggggactccaccccgtcctccctgccctcctcaccacagcccacctgtctgccgggctcttctccaggtggcaggggcacctcttcgtgtgtccccgcctccccacaggcccttgcacctcccagtcacccaagactcctcagtgaaagcaagtttgttcatgatgcgcactgatcctgccttggggtatacacctgcccgtgttctagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaaggtatgtgttgctgtcttgggtgacagcacaaggaaagagcatcacaaagttggccgtggttctgaaaattaacagtctggtcacttctagaccctgataaaatcccctgtttacaattggcttagatttttgtattttatttttcttgatttattagattattttcattcaagaagtatttatgtttctgtacatcattcattgaagtaaacctcttttttttttctgtgttttctttctttcttttttttgagacagggtcttgttttcacccacgctgcagtgcagtggcacgatcatagctcactgcactcaacctcctgggctcaatgatcctcccatcccagccccccgagcagctgggaccacaggctcacgccaccatgcctggctaatttttaaatttttttgtggagacggggactcgctttgctgcccaggctggtcttgagctcctttgctcaag

SEQ ID NO: 16914 - DNA, 1176 bp, Homo sapiens
tttaaagtcgagggcttcttaagtttcagaccaagaaaaatttacctgccagttaattggtctttcaagtttctccgtttgtttggaaaaatggaaactgttccggaatgcatgctactggaaatcaggattttccacttattttggcgagtactaaatcagtgagaggatgctgtgtggcctggcagggtgaaccggcacctccctcctgcctcctctctgctgaggggcccctccctcccccttctttgtctgctttagaaggttgtcactgtcctcctcatttctaaaggtgttgtcacactcctgagctataaacatttactatcaaattaccttagaagtggaatgaaatctagcagaaatattctgcttagactaaaggtttgataataatagaataattatgtctttgaatacgtgtttagaaaactcagacattgttggtcactgaaacagtgcagctctctttttttgagtgtggaagcttgtaagtcacttctccccaggcggtggctaccgtcacagccctcccatacacctgaactgttgtttcactaggcgggcgctaatattgacacctgctcagaagaccagaggaccccgttgatggaagcagccgaaaacaaccatctggaagcagtgaagtacctcatcaaggctggggccctggtggatcccaaggtatgttcccctgtcagaatcaacgtcctagtgtgtgtgtagacgtttctcagaaagctgagcaagggacatccttactgacatctccaggacttggggccttcacacactgacccagttgtccagaaatagttccttcatctcactttggttacctggtttattattaaaaactactagtgagtgctcactctctacagagcctgacaacagacaggtgagcgaatgacgggtttgctgtgcagaaggtgttcgccttacagtacatcgtctcaccctgtcttcagcccagagcaattaggcaagaaaaagaaatcaaaggcgttcacattggaaaggaagaagtaaaactgcctctgttcacagatgacatgtttttatatgtagaaaatcctaaagaatatgcaaaaatattgtaagctaacaaaaccaattcagcaaaacaggataaaaaattaacacaaaaaaatcagttgcatttctatatacttt

SEQ ID NO: 16915 - DNA, 1216 bp, Homo sapiens
gccccccccgtctcctcccttctcaccccccccggctcctccccccctctcgccccccccatctcctcccctctcaccccccccatctcctcccctctcacccccccatctcctcccctctcaccccccccatctcctcccctctcaccccccccatctcctcccctctcaccccccccatctcctcccctctcacccccccggctcctcccctctcacccccccggctcctcccctctcacccccccggctcctcccctctcaccccccccagctcctcccctctcacccccccccggctcctcccctctcacccccccccggctcctcccctctcacccccccccggctcctcccctctcaccccctccggctcctcccttctcaccccccccggctcctcccctctcaccccccccggctcctcccctctcaccccccccggctcctcccctctcaccccccccccggctcctcccctctcacccccccccggctcctcccctctcacccccccccggctcctcccctctcacccccccggctcctcccctctcacccccccggctcctcccctctcatccccccccggctcctcccctctcaccccccccggctcctcccctctcacccccccccggctcctcccctctcaccccccccggctcctcccctctcacccccccggctcctcccctctcacccccccccggctcctcccctcacccctgttccccccacaccatctccccagctcctcccacccacccccgtgccctctaaggcaaaggggagccccaccgtccacgccgcctggcttccttctgcatctcagaatccagctctgggactttcactttggaaatggctctgaggcccgggcaccgccctgcagccctgccccccccggccatggggcgcctcctgctgctcagtgtccccgggacaccctctggcctctgcctgcacggggagctccgttctctgtaatttcagatccagcagcgcccctgctggccgcgcctccctgcgctagtcccagtccacgcatccttggggcaccggtggcccctagtcgcctccgcatcacggcctcccacgcctcagtccccacccagaaccaggacactcgcgtgtccgcctttcacgtcaaacacgtggcgtgagagcccggagcttcgtgccgcgtccttaagcacgtgtgacaggacgcgcg

SEQ ID NO: 16916 - DNA, 2424 bp, Homo sapiens
aaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatg

SEQ ID NO: 16917 - DNA, 1320 bp, Homo sapiens
agccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattagagaacttggtgggtgtgctttcttcctctcgctctggaactcttgggcccacgttgactgaatgactgaagacagagctctgtattttctccagaaggaagtaccttgagcctctgtttaggattgctgtgtgagatagggagctgggagcagaacgcagtgacatggcagtcacagcagccgcctgctgttctgaaaggtggttctgtccagggatcatgttttttagtgtgtttccttttcattctttatttcaggctggctgttggagaaagacaaagcaaatgaatgttctctcatcagcggattggttgaccgg

SEQ ID NO: 16918 - DNA, 1205 bp, Homo sapiens
ctctccatggttttttaaacatgatttgaatagtggttcacggataaactcccctccctgtagtgacagctgctacacgtcttattttgtaggctcattttatctttgtatgtgtggggaccaggggaccaggcagccaggataggattgcgatgggccactttcacaaagcggtggcatcttgtttcacaggcatgggcaacgtggaccttgtggtcgttgagaagctggtgctgggaaagcgatgcgggaggagacaggcggatcactatctccgcagacaaatgagggccagcgcttcctctcgcccagggcagtgggagctggagacaaagaacttgtaacaatcagccctaccaagtgcatgtatgttcttccttgtgaggtccaggtggcatccacggcccgagatgtcaggggaggggtgctgcccaggagtcagatctgtcggttaggtcaggaggagaggctgaggctggcagttttgcttttctctttcttcccaggcggtttgttgttctgtctctacttggcaggggagtgctccttgcaggaaagttcagggcagacatgtagccttttattatgtgtatgtgtgtgtccagtttttttccactgcactgttttcctaggtgcccaggcccacccctggagagtcctgggcaggtcttgaatggatctgggctctggaatcttcacacagagccacaggctatttcgctgggcattagcagcggatctaccgcttgctggccttaagcacaagttcttgggaaggttaaggccagaaaccgggtgaccctttggcattttcctcattaacttagcccagttgggttagtgcaaaagggaggtctgcctgatgccctcaagctgctccggaggagaggaagcagggttgggagggtggggaaggaccgagaaggggacggcagctcctagcttagctgggctcatcctatccactcggtgccagggaccgtggctgttgcctgttgctgtcttctctctgaaatctgcgttaacagctctagggacagagtcatccatttttctcccttcagaggcaaatggctgttaagttcagcttctaaaaagcacctgtaatttcaaacaccctagggaaaatttcttttaaatatcacatcataaattattttctaaagctttgcaattacccttttggctttttccccaaatatgca

SEQ ID NO: 16919 - DNA, 1197 bp, Homo sapiens
aatccagatgtgctgagctgcaacctcagcctcagcaacatcaccgtgggaaattactgtttggcattttggtatttccacagagggtcagctgcgtccaccgccttgccctttgccattgctgttgctaaagcacaccatgccttgtccttcttctcattcttgcagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcggg

SEQ ID NO: 16920 - DNA, 1233 bp, Homo sapiens
cgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatgg

SEQ ID NO: 16921 - DNA, 1424 bp, Homo sapiens
ttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaatggagatgtctttgatttacctactttacagcttttgtaaaaaaagaatgtcctcaccatacgtcagattcttaagccatctgagtaaaccgtgggattgattatatgtgtgtaatttatttacactagtcggtttgtggtgaggaaacagggaccaggtcgcatcacttagctggtgccccagtaatgctgtgtaacaaactgtaaaatgtcagcaataatctgtgcaacaaagtattgacttagctcatgaatttgtagatgagctaattcgggctgggctctgtgctgtgtgcctctcctcttcctcatgggaccagccgtgtggctggatgtgttcatggcaggggcacaagacaacacaccctgtcacaaaggggcttctcctggctttgtcctgtcatacctgctaaccttcttctggcaaagcacatctcctggccaaccccggcaccaaagggtgtggaacaggctccaccttttagtggag

SEQ ID NO: 16922 - DNA, 1148 bp, Homo sapiens
ctttgggttacagcccaaatctgaccctctacctatatttgtaaataaagttttattggaacctggccatgcccacatgtataagttgtgactgttttcatgctacaatggcagagttgactagttgcaacagagactgtatggcccacaaagctggaaacatttaccatcaaggcctttactgaaaaagttagccaacctcccaaagtgaatgcagctatgaaactttatcttgtttactttttatttgacaagttttccttcatgcacaagaaagtattatttgtttaacctcccaaacatattctcatgatctcatgataaacacagaaagtccatactggctgactctagtcacactccttattaaaaacaaaagcaataaccagccaatcagatattctttagattggggtcaccatctctaggatagtagtcctgatggacctattgagaaggacctgcttaactgtcaaacatctcctctgaaatggtatcccagttgtgtgtgcttttccactgataagcattcttgacccccacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctctacaaaaaatacaaaaaaaatacaaaaat

SEQ ID NO: 16923 - DNA, 1253 bp, Homo sapiens
tatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggttttgaaaattttttggaataattttacacttaacgattgtttcttcagacgtattatctttataaaaccaatgctttatgatagaatgatttataacccagcacacatatgtttattgcagcactgtt

SEQ ID NO: 16924 - DNA, 1284 bp, Homo sapiens
gggagcttacattttgcaagggtacccaccatttcccagtaaggatggctcactgcataaactcttaaacaattgataaacaatgtggttcatgctgaatgcctgtgagtctgacattttggtacgtgctaggcagagggtgcttatatgaccagcccacaatacaaaccctgggacttgagtctctaagcagcttccctggtagagagcccttcacacgtgttgtcacagctcactactggggcattaagctctacctctgactcccctcagggaggagtcttggaagcttgcaccctgtttcccccaacttcaccccatgcacctttttccctttgctgagtttgctctgtgtcctttctctgcaataaattacagccatgagtgcaactattaggctgagtcctataagtcatcctggtgatcatcaaacctaggggtggtctcagggacgcccaagatgcaaatatgcttcgatattaaccgatggcagttttcttttcctagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagaggtgtgtgccctagaaacctgctgtgggccactgtcaatgttgtttttcctcatttatccccttgattagaattatctggaaaatgttggctttttcctttgatgatcaagtaaatatgctttcttattttgtttgttgaagatttggctttgaacctaccctgacattaatattcaaagaaacaggtaatgcatatttttgcaggtattaaaataccattattgtccttgttataatgaaattattgtatgtctttgtggtggtggatagaactaaatacacacacatacatgcacaagagtacaagtcaaactagagcacatctgaatcagatcactggattgtatcaatttcagggtcctggctgtgatactgtgttatagtttcacaagacgttaccacagggaactaggtaaaaggttcacaggatctctgcgttgtttcatacaactgcatgtctatctacaattcccccgaaataaaaagtttaattaaaaaaaaaacccatgatctctttttaaccttttaaaaagaacagaaatagtatcattgaattatgtttttcacaacattagcatcagagg

SEQ ID NO: 16925 - DNA, 2227 bp, Homo sapiens
tgacccctgagttagatgatcacagttgtgctcttaaatgacgcagtcaccgccttttcagaaacagaaagaaaaaccttccgtataatgattaaacttaatttaaaacaacaaatgcccctggaaaaggatgtctctggttaacagtatccctgaaaagccttctgtctctgcattgaaaatctcccttccaggatcccatatgggtctggttcaacgggttgtaatttgaagacataccccaaagctgtctgtcctctcaaaagtgtcggaagttttgatagcaacacatcatgtatgctgcagaaattgtttctcagctttccagcttttcaatgtttaaagaactctaactaagatgtcctgcttcccttctccctttgtttttctcattggcatttaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttccttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgcgttcatagtttgtatgtatcattgtggagtaatatgttttgacggagtgatgtgttgcagtacctgaaaatgtttgctactttacgattataggccagcatacaaaattacagaaaagccagaagttaattgatgtcagctgttttccattttgaaggtgtttcttcctgaagaacttaccagcaatcgcctttcctcaaagcgtaacagctgtgccacataaggtgtccacgttgttaattccacatgtttcctataaaattaaagatggtacagtgtgttcacgcatcagagtagtgatgttcaatat

SEQ ID NO: 16926 - DNA, 1381 bp, Homo sapiens
ggctgagatcgagaaattcgataagtcgaaactgaagaagacagagacgcaagagaaaaatccactgccttccaaagaaagtgagctccgacccacccccatctttagaaaggctgggtgggagcggccggtgggagggcgggaggctgggagcggccgcgggaagaattcgggaggggggagtgcgggggaagagccgacagttgatgaatgtggcttgcaaaggttaattaaaaatggttttgcagccaacaaacacggggctttagtaatttagtaatggaatatttaatatgccatattaatatacaaacatttatccattaaaatgtatttctatttagtatattcaatatacatattttattccattgtggaataccgtgtagaatgtttatgatttgaaaagatgctttaaatgaaagccctttagtctgtactgaatcctttaatcatctccctccatcttttttttttttttttttctggtcacagcgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaacttagctggtgtgtctgtttggtttctggaaggatcgcggatgaaacctttgcaaagaggcctacctcttggtccattggggagggacaagcatctggtgactggataaattcccttatggcatagaaatgggtttcacccaggtatgcaaaataccttgtctatactaggagatcattttctcaggctgattgaattcctagtatgaattgtgtgagagctttaataaaaatatctttgcagttcttacgggttttgataagctgacattgcacgtgctcaagaaaatgaaggtgataatttacagcacagtatcttatttcagggtatcaaattgaacttggttatttaaccaagtgctagcattaacatagatgagtaaaaattacatttttagcagctgcgttaagaaggaatttaggacttgagcttactcatt

SEQ ID NO: 16927 - DNA, 1561 bp, Homo sapiens
aacacttttccttcccagctgggtgcggaattcaaacccagatgaacaaatgatgacttacgtaatttgtaacgaatgtggggagcagtggtaccatagcaagtgggtgtgctggtaactgtaaatcagtgttctcttaacagataaccggagtgataccttttatttgtacaacccttttgtgcttttaaaaatcttatacacactactctctaaaacagaaaaaggaggaaagaaagtcgttagctgaagctgccaccaccatccctaaaagttacagtttggggagagggagtggatgactatttatattgtgccttgtggccatttagtaccttactgtagacagagtgtgggtgagaacagcccagcataaactgggagactgtgggaaatgcattcccaggcctcacaccattgaatccgaatctgcattttgacaggatccccaggtaatcttccaggataggatagtttgagaagtgctactttagcaataggcctgtggctctcagcagtggctgcatattaaaatcatctgggaagctttgaaaacccactggtgctgagaccccaccctagaacaattcagttggaacctatgagatgggacccaggcatcaacatttcttttttcattcctcaagttattttaagatgcagtcagagttgagaactactcagaaataggctctcatttgatcctttttacagctctaagacaagaatgttattccaggcacttcacgaatgaggaaacaggtccacagaggtgtggtgacatgtccaagtgacacaaccataaatagtaccaattctgacagatcccagattttctccctcctgactcactgagactggctcaatatcgacttctgagaaatgtattcctggaggtcggggacaaaatgaagaatgtgtttaaactccaacattgggtgactagatcttcattcttttcccctctcttttctcatttataggtctcccttcaaccacaaaagtcaccctggaactcatcccgcagttagaattttgtttggagccctcttgcttagttgaaggagtttcgtagttgttttttgtttttgtttttgtttttgttttttccccctgtgaacaggtttttcgggggtatgtaaactctaggatgtttagtttctgatgtcaggagtcttcatgttctcaaggacaagtgtccttgagatggacattaatggtcattagtctgtcagaggaagcccatcactttagcctttgaatgtagtaacagacgtttatctaataaatgaattgaagataaaattacctctttgaggcctttgcaaacagtgtttaaccagtttatataattgtttgactacaacacgccttctatgtgattatggctgattttttttccttaaaaaactcatggaatgttcaccgttttatagttttaaaaagtttactttggcggtctctacaaacctaccatttcactttctcaccagttcttttctcctaactctcttcctttgttggagctctgaaggcctaactgtgtgtacactttacctgc

SEQ ID NO: 16928 - DNA, 1146 bp, Homo sapiens
aagctgggattataggtgcgggccaccacacttggctaaagctgattggttattaaatgacaaaaacacatattgtaccttgaatatgtatggactaattaattaaatcccacagttagaaacagcattatagaagatttaagcacataagtacacttatttgttactttgtaactaataatatcattatttcatcccaggattgattttggctatttatcacctataaccattgtttgagtgtttattttcagtgagaaaccacttccctcttgagactctcccactcccctcagcccaaagcacagtcaattctgctagtttcaatatgctgtaactaggtcagttcataaaatacactgaggacttctggctctttccttctacttcccagtagtgatatcatgtagcagttttagtctgtggaactagacacatgtgattttttcctaaatttgttagctcagctatggtagtttatttactttttatatttttgttaatttcaggaaccagaagctccaggaagaaaaacataaaagcataactgaggcacttaggagacaggagcagaatataaagagttttgaggagacctatgaccgaaagctcaagaatgaacttctaaagtaattgtttagcatttttaaataactaatatgtttaaattaaattggtagaaacataacaaaaactgacaaagtagtctgtaacttaggcaaactttagtgtttgaaaaaaaaaaaacatagttttatcgatacagtcaatcctttcctgcatttgagttaggatagtttttaaaagataagggccgggtgtggtggctcatgcctataatcccagcactctgggaggctgaggtgggcggatcacctgaggtcaggagtgcaagaccagcctagccaacatggtgaaaccccatctctactaaaaatacaaaaattagctgggtgtggtggtgggcacttgtaatcccagctactggggaggctgaggcaggagaatcacttgaacccgggaggcagacgttgcagtgaactgaagttgtgctactgcactctactagcctgcgtgacagtgacaatccatctcaaaaattaacaacaataaaaaaatacagagaagcacatcctctgcgcttct

SEQ ID NO: 16929 - DNA, 2371 bp, Homo sapiens
ggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacactggtgtgctactttgtcttaatttgggcttttctgtttcagtttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccaaattaccaaggaaccaacatttagatttagatatttgttttcacttaggaatggaaattaatagattttccatgaaagcattagtgaaatatcattaccttgatctgcaagtagcctaaaaatgcgattgctggtaaacctggcctcaaatttcatactaccataactgtttttatatattgccactaattttgactggatttaatagcactttattgtacaactacaaaaaaaaatatattcctagaattgttgccagtgtaatttctctaatgttctggtgcttttcatatattttcagtatttttattactatattggtattttctttgtataaattgattgattaaaagaacatgttttctattttaatatgttttagaaaaataattacatttatgaaataa

SEQ ID NO: 16930 - DNA, 2159 bp, Homo sapiens
tcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataattttctgagtttgtcttattttatgaacagactattatttactagtggaacaggctatccctgcccccgacacattctttttcagtgcaatttggatgtgttgcttggtctattagtaaaacaagaaataccctttgggcgatgaattactctgtcattttttgtttctagaatatcttctctctctcactcatggaatagcgagttcaattgtgcctttgtttccttacccaaataagcccttgtttttcattgccctagcattatcacgtgagacaaggaaaatatctacaaactatactgtgtatgtgagctacataattatgctttctactttgcccaacacaaatttgtaaactttcttaaaacattatgagacttgtgattttctttctttctttctttcttttttttttagctcatcagctattagggtattttcatttatttatttatatatttttgagacggagtttcgc

SEQ ID NO: 16931 - DNA, 2701 bp, Homo sapiens
aaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagtttggtcttcaaatatggaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaaaacattcagtattaagaaattttgtagtgccacatttattgaatcacatttgtgctatataataatatcaaacaatccctttaagaacttattagagagctatgtctgaagtctgttctgcaatatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatattggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcaggtacacagataagattttccattcttaacattctcactgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgtacttcgtctcatgtgaatgactttttcttttccatccctcataaaataacgttttatattttcatttttctaggcaaattttttaaattgtggttaaaaacacataacacagaattcaccatcttacgcagttttaagtgtacagttcagttgtgttagttaagtttattcacattgttgtgcagcagatctgcaggactttttcatctggcagaactgaaactctatacccattaatcaacaattccccatttctc

SEQ ID NO: 16932 - DNA, 1122 bp, Homo sapiens
tgggttttctgttgaactgtgttgctgttgtgtttgcctaggtctgtgaagtcttctagccaagaaattttcatttgccactacttaattagcatttgaaatcttaggctgatttttccaatttaactctttctgatgatgtcagagatcttaacatttttataatagtgttttgaaagaaccttaacctattttcattcagtttcttttcccagtggcattcttaattgaattgggtttctcagttagtatgctctgatgccacaaagacttatcgtaaaatatatattgaggtcagttgtgagaaattgtcacaatttcttcataacattgggaagatttcagaaaaaaagttcagggtgtgaagtcatataattggttctgaaaatagagcttgagcatagtcactagtgattggaccaagcattgcacgaatggctgaatacactagtttaaaaaaaaaatggatagtcaagtttaccctcattttgtattgatttcagtggtattcttgtgcctggaggctttggaatcagaggaacattgggaaaactccaggcgatttcttgggcaaggacaaagaagattccttttctgggtaaaactcatgtttattgaccctaactatgagtttattagatttttgacacctaggaggggtaacactaaaggtttgttatcgtaaaggtgtgaactcggatttgaaagttcaggtgccaaatagtctgctatagggtcaacaaactatattctaaatttggcccacagcctgtttttatgaataaagctttattggaacacagccacaccaatttgtttacatattgtctatggctgcttttgtggtccaacgtcagagtttcagaccctacggcctagaagctttactatctgaaagaggctagaatctttactatgtgaccctttacagaaaacgtttctcatcctaggagaacttgctgctattccagctgggtagcagaggctgggagaaggctccatctgcaactgtgcttaccttctccaattcccacctcagtctccagagtagctgggactacaggtacacaccactgtgcctggctaatttttgtgtgtgtgtgtgtttttttttttttaaga

SEQ ID NO: 16933 - DNA, 1108 bp, Homo sapiens
acaggcgtgagccaccacacctgacctgtccaatcgttttgtgtacacttcttttttttttttgagatacagtcttgctctgtcacccaggctggtatgcaatggtgcgatctcgactcactgcaacctccgcctcctgggttccagcgattctcctgcgtcagcctcttgagttgctgggattataggcacatgtcaccatgcccagctaatttttgcatttttaatacaggtggggtttcaccatgttggtcaggctggtctcgaactcctgacatcaggtgatctgcccgcctcggcctcccatagtgctgggattagttttctaattaaatgaagctaaccttgtgcaaattctgatgctagctttggttgctgggtttttgtgtgtgcgtgtgtgtgtgttatatcagtgtaaataaactgccagtctctgctgaattttgtttcattcttgtggtggcatatttgaatagatccatctaagtatggtgatttctcatcgccacttaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtaagcgaaaggaattacttgtataatctttaataatttttgagtttgggggtagaactaagacctacttgaaagggtaagcgtgtgtatttggcattttgcgtgtgcacattttggtctggatatgtctaaagatggagcatactgttgcggtgctttgctgtattatttgaagatttctggagcctttgattttgttatacataaaccaaagtgaattaaaggaattcgaattctggaaggaatgtttttttagctctggaaggattctgatttatttgatttatttgctagttcattttttagtttctgaatatttaaaatttttttttgtttgttttcttttttcttttttgagagtcttgctctgtcacccaggcgggagtgcagtggcacgatctcggctcactgcaacctccacctcctgggctcaagtcatcctc

SEQ ID NO: 16934 - DNA, 2042 bp, Homo sapiens
atattctccacttcccatagaaggccacttattctttgaaaactggtgttcatgtttgccgttcaatgaagtcccttgtcaaagacaaggacggtcaattcacgtgtcactttcactaggcagaagtttctccaataccttctggctacttgaaagttactacaaaaattccaccagcaaagtactccaggtttttcaaaagggaattttcattatggatcagtaccaaccgaaattgattttcatttccaaaacaaacactggcaccaacatttttactttgggaagacttggcagagtgttagtcatgatctgttacttacgtgttcagtctgttttctcacccccttcttagttaccatctcttttttaagaagaaaaaagaaaagccacagtattatcaaggtctctacacttggactgggggaaaatttgaaattaagcacataacttttgaattagttctttgtttcaatgttgaatgtggcgcagttatgcagatgattaatcaggctgcactgatggaagttttgactttgtccctggtataatttgcattgaaatgctttatgaaataaaaggttctactagaactgatgttagcacattccactgagcaaaactatcagactgacacttgttaaattgcttactggactgaataaactctgttttgtccagttaaaagggttttctctttgttacaagtgttatttgtaaagtcctgtcacattcatggtcgaaactgggttgaaagaattgaaaattgtccaacagatagatagataggaaaccgcctggagtggaggagggttgtatctaagcctccactatcagtcatgttaattcaaggggccacagtggaggaaaataaatccacaaagtagattatctaattaccatcaaaatgagtcagaagcaaaaaacaccaccctccaacagcctcttaggagtacaccctgttctgctactaaaatactagactcatttccctggtggtgggggggaatgcaggtatagatcagaaatataatccaccttaaaattagtactaatgatcacattatttcacaagaactctgctggatgtacagctcttaacattttattaagccatttgtgtagcccaccacgtttctttgtggtgcttgtcctgtgtggaagattgtaaatcttgggcctgttgcatacttccaagggctttaaagcaatgtgattaacagtacttggcctgctgcttttggcttactttgtatttttagctagatgctattatagtgttgaaaggatatggattctgtctgggatgcatttgttgtcctttcagaacccttcctcccattaccctgtgaataaaaacaaatgggaccccctgagaaggacatcttcctacagtgatcacctcaccagcccagtgttgtggctttgtagcgcaccccgtatctaccatattctagaacactgtaatgctactaggctggcccagaaaaggtttaaatgttgaattcacttaaattgcaattgttgcaccatcatggaatcgtgatgtgtattatttatattggcggtggactccaaggtgtagagaaaacttgggtcttgggtaatatggaccatttcatcctcagacttgttaggagtacatttcttggtcttgagaccagtatttttcagttatgtatgcaactgcctttattacacctggttatcacaattcaattctcaggtgttgcagaaaaatctacctctttcagactgtagatggaaataactgtgaaaaaaatgatgcagatatcttctagtttgtgctaaacacactgctttatttttacagcccacgtctttcatgaggatacgaattgttaagaggcagtctcgttttgcttttcaaagacattttgtagagatttttcactaatgtgaatctgattttatctacttgattctgtatagattaagtaaatatgtatgataaacttaacagcttctgtgtattctttcattatccatgtgaccttaactgtaggagtccaaaggtacca

SEQ ID NO: 16935 - DNA, 1245 bp, Homo sapiens
gtgtctgttctgtgtggtaggcatgagggatacaggaaggagaggtcaaggcattcaaatgacagcaagttctctgaggatgagcactaagtagctgacatttctaagttgttgttaaccgagacttccataacatctgggctaccacttcctctaaacgatgcttgaagtgcctttggaaaacatctcttatgaacagtgattgaaataagtagtgcatcgatgggtggctaagtatacatacggaattacacactggcaaagaatttttcaaaatactggctagcctaccatttccttattgaagtttttaagagagaaatgtaaaaatgaaactattaagttctaaatagattaaattgtttttacatgaccatgtgaaaaccatagggagtttttacctgtgaatttatttggttatctccaggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaactagaagatatctgcatcatttttttcacagttatttccatctacagtctgaaag

SEQ ID NO: 16936 - DNA, 1206 bp, Homo sapiens
ggatattctcctctgctcttacactgacataaaggggcatctattctcagatgcaggtcctgacaaatcagtgtgtcagttgtaagctatgcctcaagtactttgttattaatgccagacatttgggaatgtcttacttttaaatatgaattagaacagatttaaggctatagctaacttcactctcactcccagcttgatatgctttcttgagtgagagagaaaacagcttgcttgccaggaattgtatttgcttgcaccatcagatagatgtatcttattggaacaaaaatgatgagagtgctgtaatagaggttggagaaatgcatcttccacacagatgctaagcgagaaactaggtaaagcgctggtccaaagacccttaacaacaagccagtgggtagcttcgttaacttagattttcttctctttctttggggctcataatgttttccctggtggtgccaatcttgatgctctctcaccatgggtcagccacctcagcccctttagtataggggccctaaaggtctcttgcccattgtctttccttcatacaattagccctatcccccatcctaagcactcattgccaaggagcgccattcctcttagttttctgctggccgttctttgtcctcagccctaggtggaggtccaacttccttgcatcttctcctgtccctgcatacaatgagcaggggctagccggcctccaactctggaggagtttgtcactgtggggaaagggttaatgtaacctttccccttctctgtggaaatctgtccttgttttaactttccagctctgttgccctggaaacgtggtgaaggtggaatgtcagctgtgttaccaggcagtattgcttatagtagaaatgacccaattgttaaattgcttttatgccacaggattgtaaatgaatttgaatacctggtgaaaaaccatagctttgggcttccctgagtgtcaaactcttggtactggcatgtcccatatggggcccctggaaactttagttgtttacaagacatattagctcccgtggggtatggggcttctaagccaagatggaccctatactctctgaagtgcttcttgtctgtttgcacctgagctgccacttggagttccagagaggaggccctggacagcatgtgggctgctgtaaagacccccacagaggagggatgcctgaagctatc

SEQ ID NO: 16937 - DNA, 1156 bp, Homo sapiens
gtttttttcctggagtcaccaaccagctttgggagacacagccgccactcccccagtctacttctttaaaaagcatttaacaggttagtattggcatattcaaattggcagttctttatgtctttttaaattttcattgtacagtttacaaatatacttaatgtagttaacagagaaaaacctttgattttggttaacctttatatctagaaccaaaacagctaaatcccaaaggggaaaatatcagggattgacaacttctataattaaatccatgagaatttttcctcactagagaatttaaaggtgcacctgtagatatcatcttttctcagatattttgtgtgatactctgtggtgttctgttcatgttctatcagtatatctagaaagggaatagccatataaattattttccttttattatttctctgtatgttgtatttgatcatatttaaaggaaaaaagcaagcttataagctttcatgaagtgttcttaccagtttttgataaattttttaaattataggatagaattgtcattttatgcaggagatatttatactacgagggttgtttggatggagtcagattaaattttttcagtgaaattcctattattttaaaactttccatattttcactacgcttggacatttaactaggcattcttttcttacatctctatatgaagatacctgtgtccaaaatttttgaagatatatattgtatgtgtttattcttcatatggtactttaccatatttatatattgttttatacctgtaggtttacacacaagtaaatcttttttttcttgaatttaatctggcactttgcactgccacagaggtgacgatgaactatgtatatagttagatgttttgatttcgtaaaaaatatatgtccatcgtttgctatcaccagtacctctcagcttactcttcaggggatatgaaacaatctgtagattggtttccatacagggaagttctctgtcctatgcaatgtttctaattaatttgcttagttctgagccatttattctgctacactttgaaagatatattagttctgacttattgtttggggctttattttatttttatttttttgagatggagtttcactcttgttgcccaggctggagtgcaata

SEQ ID NO: 16938 - DNA, 1053 bp, Homo sapiens
caaaatgtgctgttactgttaaccctcccccgagattttgagaatcatagctctgatgattatgaagattataaagactaaggtcctagtttccctgaagcttaaattgtgcacatattgcatttttatataaatactataatgtgtattgattatatagataggtcattttaaggtgctttttatttaattttaatgagtgtaataggcactaaaatgaaactcgactgggtactattactgaaaaaatttgactcaaaccaatagttttgcatgctctttagttctttttctgtcttacttctttcaccagttcagtactgtttgggtagctctgaattctggcttttccaggcagctgcttgatgatacaaatgaggtggaccatcagcagttttgcctggacactaatgactctaaaagggtgtgtatttaactcttctttttcatactagatctctaccttgtattccccccttgcaaaccagaaactacactttttttctctggaaagacttctcactgtgctatgcgcttaggaactgcacggtcccgttgccatgctgtggcattcgaggctcgtcacctaggggctggtttcccatgttgtcatccttgctaacactgggatctcagatgtttgcagaacatttctattcatgacggttcttcaaagaagggctagaatatttgccttctacctagagcaaagtaaacctaattgttgaagagtcaatacgtactttttgtactttcccagatttgagccagaaaatacctacagatatctacaaatgttttcaaccagtgttttcgaggtagctctttaatcctcttctcagcttttgtctgttctgacttttcatccaataagctgtaagtgaactacaatctgcatttccagcatgcaattctcttcctgctcacggagggggatgcaaaagttttctctcacacctaatgggccctctcttagcttttaactgttgttttcccctgttgatgaaaaattactgacatcacaaagattgccatccatggtagaaaggactt

SEQ ID NO: 16939 - DNA, 1157 bp, Homo sapiens
gcatcaagtggttagaggccacagatgctactaaacaccctgccatgcacaggacagccccccaaacaaacagtggtccagccccaagcactactagtgctgaggttgagaaaccctgccctacaccatcccaagcccaccagtctgcagagcttggctctggccttgttctgtccaggctacagtactgcaggtgtgatttcttcaacatcacattctcttaagagtcttcaaccactatgcctgaatccttggaatcctattgttcgtttccattgtcttgggcctgctaaaaggtgcatactttggaaggagaccagagttactttataggtgttggagaacttaaattctaggttagcatccttagaaaatctttcatagagccatgaggcttatatttagaagcaagcaacagcctggcagattggcatgatttttaccaactgctcaaaggcatccgtggctttcagctgtgtctcccgaaagaaaatgtctttgttttttattcaagtcatttaatagctctttacaaatattagcatatggcagaccaattagaagcaaaaaagtccgtattggtggttgtgatgtggctgttatagaagtatttgtgctgtatgctttggttaaatctgttttaaaacatgctttaagattcaccttacgcagttgtactttaattctaagctcagagctatgctgtcagtctctagtcacgccatgtattataaagtatgttgtggttgtagagttagccagtttagcatgttcctaatctgagaattagtggactatactaggaaatgctatcccattttccctttccagcccctcttagttaagatcatagtatcctcacttcttaaactagtctttagagtaaataaggaaaaaagccatttattttcttctagccatgtattattgagaatgactcatagtacaactttttttcaaaggccagaggattactttgcaagtgtgtagaaagatctgtctatttctgttcacctgggacctggtggtgactgaactctttcagcaagggcaatggctcaatgtgattcggtgctggagctcagctgggactcagtaaatctgcacgttctctgctggtcagaacatgtttcctggagagcattgcttttctatct

SEQ ID NO: 16940 - DNA, 1229 bp, Homo sapiens
tcacaggtacactctgatatacagttttacctttagaatagaacattttgatgttcatgcttagtcatcattttcttctaaatgttccaggatcagaagttcagagaagcttcacgaaaactagaatttattattagcagcttgctgttgttctgtggggggaagggggaggagctagaaaatgaaaataaaaataaaagcttattcaaaagtttggaatgtaattcagtgaaatatttgaataagaagagtcttagttgtttctttgaaggttctttcaacctataactcagttggcttctaggggctttcagtgaaaatcatcttagaaagatttccttcccccaagccccatctcattgcacagtgaggtttatggatttaaggaacagaggcgatatgaagcattactgatgtgctcctttgcagtttttcaagttcaatattatttgcaatggagttagatcttagagtggtcaacagtgtttgcaatgtagtatgtggaggataataactaccttattccatttcagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggtgagtggtaggtttgtggtggaactgtgttatttaggtactgaagtatggcttgtacttattgggctttaccctgccatatgtatcagaagagtttgaggctggtaatgtaattttcttttatttatttatttttttgagacagtctctctctgtcgcccaggttagagtacagtggtgatcttggctcactgcagcctctggttagagtacagtgtgatcttggctcactgcagcctctgtccactgggctcaagcaatcctcccacctcagcctcccgagtatgtgggaccacaggtgcacaccaacacacccagctaatttttgtattttttggagatacggggtttcactatgttgcccaggctagtctcaaacttctgggctcaagtggtccgcccaccttggcctcccaaggtgctaggattacaggcgtgagccactgtgcctggctgaagccagtattttagaattaaaaagtagaatgccaaaacctgctatgaagcttaggctaaagaatt

SEQ ID NO: 16941 - DNA, 1368 bp, Homo sapiens
agaaactgaaagccaggcagaagtcagaaataggaatgtgacagagaagagctggccaatctcctgccattaatgcctggctgggagtgggtggaggcacatggcaagcgtgcctgcacgctggacccacccccttctttaaactgcagcctgccttcttgttcccgagtcatttgaaatagccagctctctgcaggtacgtacctctaaggccatgtcctactactgctgggacacgagcgtcacctccatatgtgaggagaatgtttttattttcattaggtttttaaattagggactgcagttttaagctctgttggcttgaagcactgactctgaagacagctgtgtttgtttcccaggggtggtctcctctgcagactctggagtgcggtctcccagtacagaagggctcaggaggcctcagaaaccaaagacaaggcttgataccaatcagctaagctgtggcagagtgtcccaccacgctacatgttttgttaaagcttctgttagtgtatacacgaattccgctgtgtttacatatttaaaaatgccattgttcaattaatagtttaagaacttgttttaaatactgtcctgagtttcttttgaaacctgttatttataaacatagaactgtgtgtattgtgaaaacagtgagccttggttttgacctcccggaatattaggaaattcacttgtagtcccagctatgcaggaggctgaggtgggaggattgcttgagcccaggaggtgtggaggctgcagtgagccatgatcacaccactgcactccagcctgggcaacagagcccgaccctgtctcaaaaaaagtacacccttcagcacttgctggaatggtgaaacaaacaaggggtatttaacaaacatggaagctgggacactgcctcagaactggtatggtacttcaatttgagaaacacaaaactgatacgaatgtgccttgtagttaatgtttgatatgaacagaaaatagcttcatatttatactgaatgtgtaagtagagaaaactaagttatgtggcctttgaaatgattacaaaattggaatgattacaaaagtcttattttaaaatggaactgtcctcttgcctgataataaatattgtatcttgtagagaaatggtcagcgcgaacaggctgcagcaccagcgctgctcggggtgggtgctatggttggtagaatgctgtgaggggccccgccataatggtctcctcccaaaaaggtggctgggggcaggggaaacaggcatacaaggaattgttcttccttttcataattagagtatttgttcaaagtatactattttaagtcaaaaataatctttaagcactcaataattcatct

SEQ ID NO: 16942 - DNA, 1352 bp, Homo sapiens
ttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctgggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggc

SEQ ID NO: 16943 - DNA, 1190 bp, Homo sapiens
ctgtgtaacgtagagtatttctcacggtgattagtataaacatattaagatgagcccagaagacagtaaatcccaaaaaccagaagctcagtgaaatgaggatggcagtggctgaaaatattatggttctagctaatggtgaatgatagaagaacccttgaaattcttctctttgaaaaactaaaatagacttgccctaatctgtttgccctgctgccttctggtggtgatgaggggagcgtgctgagggaggggagtggtgatggtttctttccactaatggtttctttatttcacccttgaatggctctttccaagccagaaaggaatatacaagtcatttatcacatagaaagaatccatacggcaaaatgagaacatgttaagggggaaatgacacaatatttagactccaaaattatatctccagcagggatatttgcaaaaacaatgaacagataaacacacaaatggatagatggatagctaatgggggagggttcttgatgtttacacactctaatccttcctgtgaattgcagccgacccccttgttgtgggctgttccccattcggtcctgtgtttttgctcacaaatgctggttttcagttaattaaaatgtacactggggaccttcctcctcccccacccttttggcttaaaaataccattttatggaaaatgacaacaacaacaaacaaaaccattgttttaaggatttgattctgaaacgtgttagcagtttataatgacctttctatattttgtctgttttcatttaacagtttcttcctgcactgagacttccttatttgaatgacttccacattttatgagattttatgtgagcaagtatttggtgtatcattcttatggactaggaggccaccttacctgtaggaagataatgcacaattggctaatagagaacaacatttgatggcgtactttcatttcaagggcatggttatgatcaggagttatgtagtaaatgttcaggagctattctacacatctagaggctttcagagacaggttaatgacagagtttagtattccataaaatattctttgaatcctgccctttgatggcataattgatatactgaccatcaaaggaagaatacacccagaaattaactagacacaaataggctcttccttttaggaacatgattgtgggcagagc

SEQ ID NO: 16944 - DNA, 1326 bp, Homo sapiens
tcaataggaatatacagatgttgccacaggaatctaatctgaaatcgtacaaatggaaatgacgctacaggaggatgtttgggagcatctctctctttttgtcaggagttagaagtgacactaaggcactaatactgtaacttcttgataaaataactttattttttagtagtggaatgctgcaacttttttacacctaacaattgcttttaaattacagtattcaatttaaaagttgtattaactacagtttcctttgcaaaaagtctcaaaagaatcacttgaagggcattatttgttgatgcatttttctctgagcatggtttcatagagagaacttcaccaagtaatattcagacgtttatatgttgaaagttttgcttacataataaaaacaaaaacaagtgtctgaattgtatagtgtctttacatgaaagaactttaaacagtggccttatggtagaaaattttataccagatttttctttttctgatgacattttggcttataactcgaagttttcttaagtttctgaagatcaaggcctatataattcatacatttcatattataagaaggcaagagacaaggtgcttcaaatattccatcaggtagttgtgagtgcactgaatttttagtaatatgttcattcagtttttttccacaactatttgctcttttccaatttcaaaatgctattgtggaaaatatgtaaagattttgtaatctatagtccatcttatttttccctcagggcaagcttgtgcatatcatatttttaaaggctttttaaaaatctgacaaacaaaatctcatatttgaaaattgtactttactactacagcattacacattttgcaagcacatcttatagagtgtttacttttagttcagttgatatgtattgcatacctactatgtgtaagagcaaatggatgggatttttaaatgaaatttttaggccccaataccttatttctttatgttttctgtgttctgcttaacagtacatatacattcccaattacatttttgtgaaatgtttatttgtaataaaataaaatgttgttgctctttctgcttaaataagttacttgccagtttgtgagagcattattttaattttgtttgagacttatagccttggatagcacctctgtttaaacagtgtttaaagcactgttctgtgcttacaaagacagagctttcaaaattaaaatgtgaaggttgataagaacttggtttttcatgactggatgtgaaaaatcttagtacattcagttttcttgtccatatctttaaaagagagggcagccttttcctta

SEQ ID NO: 16945 - DNA, 1487 bp, Homo sapiens
ctctgtctcaaaaacaagcaaacaaaaaatcctgaagctcagtgtgcctgttggggagattggagcgaggtagcaagggccagagcagaaagggctttggggggtcacgatgaggagtgtggaagttatcttgttgccagtggggaatccatgggaaagagtgaaggtgggcctgcagaagacacaggaaggggctgagaagcattgtagagagatgcaggatgtgacacggagaggaatccccaagggctgtggaaatgaggctttggagatcagaggaagatcccagggaaggacctccctcccagatagggctgcctgagaagagccctttgtggcctcagtacctcatgatgacgggagagaggaggctgtccttcgctgctgtggtcctacagtatcagaggcctcagctctgccagtgaggggaccctgagccagtcatacaccttgcctctgttgaatgggctgggtcatgagccattggtgcttccaccagtaagagctgtcagcaagaaggggaggggggcagtgctgccaaaggttctagagcagtaattatctttcctcaaaacacacatttcacatatggtttcagggggttacagcccccagaaagcctgtccttagaccccagattgagaacctggttcaaggagtgtttttccgcattgctaacctccaacttagataaataacatttgttggaaaatgaggggtttagccctaatgactatcatttgtaattttagtagtgatagatcattgagatttcacttgtgtgctactttaattgtttctgaaggggctttttaaaattattcttgtttatttcttggaaaaaaaggtatactaataaaatattcttattttctctgtttccttattagggatgatcagaattccagtttttcaaaggtaaagaatgttcatactgatggattccaaaaacccacacattttataaaatcaaattttagaaaatgtattgaaaaaccttacatggtaagattgcagttccaaaatttgcatttttataatttcttcttctccaatacatcaaaatgtgcagggatcaccaatatttttcacgtttgtaattgttcattaagtatatgttataagattccgttgatgcttaaagttattatgacagaagaaatggtcatttcttacttgatttagtaggattttattggattcattaaataaagctaataaatctagctttcttaagattttttggggggccaggtgcagtggctcatgcttgtaatcctagcactttgggaggccaaggcaggaggattgcttgagcccaggagttcaagacctgcctgggcaacgtggctagacctcatctctacaaaaaaatataataataataaaagaaaaaaattcaaaaaagattttttgggaacaacacttaagatctcttggaacatatttattaaggcataattcacataccataaaattcacccatt

SEQ ID NO: 16946 - DNA, 1737 bp, Homo sapiens
tatctgcaggttttagaaaagttccatacaaggaaaatttgacccatctaaaagaatagtcctatgtaaaatactctatcacttctgttgagaaatactgtataagcccaggaggaaaatataattgccaagaaggtagaaagtgccacagtgtgttgtgatcgttttagtgagagaatagtgctacaaactgcacaatacttggttttccctttgatctcatctggttttgtttctgaattgacacaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgat

SEQ ID NO: 16947 - DNA, 1227 bp, Homo sapiens
tggttcccctttaagaagttctaagatgaaaatgcagctttgcaaaatagatctcagtgtcatgtatcaccccaaaaactcaaattatatttgcattaaaattttctcaaagcaaaatgttttatgcttttaactagaaaggatgctcttggttctggagcagaattccagctctcctggttagggcaaaatgccttgagataggcctcaaggagttaatgcttattgggcattattcctagggcagcttctccccagggaggggaggggacaggacacacggtgtttaggttgagagccagtgctagcctagccgcattgtttactctccacctactcagaacacgctggtgtggcagagagagcacgtatgcctgggttttggatgctgagcacagaaagccccatttggtgactcacactgtgcactgaggcagcaggtagtgtggtggggctgggtagttaatcttgttaacacttgccttacacgaactgtgtaggaacggctggaggcgatgatgcgccggtccctggagcgcacacagcagctggagctgaaaaagaagtattcgtggggagcaccactggccattggacccggaggacatgatggtgagtgtagggttgcccctgtatttcaggtcctgggtgggaaataatggagcaggcaggggattatgggcaccactgggtgtctccaggatctgggggatgctttgcacagcttttcagaggcaccactttcagatgtgatgtttaaaactgccaagattcctacgcatgcatttgttatgaaggggatctgtgcattcttcttgatagcaaacagcagttgacacaaaaactgggttttgagggagagcaaaagagaagactttgaacgcagagcccagtgagctgggcccagctggcaagcccagggttgttctgacttcaggggagggaaacggcaggaggctctgtcactggtccagatgcgatcaggaaaagcacagtggcagttatcctccaaaaagggctggactatttcctgctgcattttaaatttttgttgctttttcgactttgtttcaaggtgacttatttcattaccagttcaaactcatctttaaattttcaaatgtgtaatttaatatatggattgttactagtctctggatggcttttccttcttttcagtgtctcactacatttcagcgatcttagcattctattatgcaggaggtg

SEQ ID NO: 16948 - DNA, 1516 bp, Homo sapiens
tttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgt

SEQ ID NO: 16949 - DNA, 2284 bp, Homo sapiens
ttatagaggtgtcttatttctaatgcaacagacccccaactttaacagatttgatatggatgcatttattcacaagcaaccccaaaagtccaaaaatgtaataattttgacaaggcccaaagttgagatgctatgaagcttgtgtgtgtgaaaagtcagttatgattgtctggagagaagctgtggtgtgtatgctgtagagtttccacatttcacatgcagtgtactccaaaaagcgggtttgggtcaaccatttcccatctctttttaagaagtgactgctgttggggccaggggacatcatgggaggtggggctgtccagttagctgtgccctgcaccttcagcccaggaaagatttgaacagagcaaaggcttcaagagagggcagaatgtattcggcagaaaagggactcaggtaagcccagcctgggatgagagcagaaaagcattcaagatttgcaggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggtctccccaagtgaccattggtggagaccaattaatgaaggaatgaaattcactttattgggactgtggtattcaacagagccacacttaaccactttttccaatgaagaatctccagaatgataatgcccaaatatggatggccaagaagaatttgtatctacggtgtgctttatgtgtttttgacactgctgtattctgtgtgatcaagtgatttgcagctggttccaatgtgactgagtgttctcaaagatttctagtaactaagtcaacttaattttcttaagcctggtattactatcagcctcacatttaccactttgattctagttttttaactgttcataacagggcataccgagggttgggatgagagcctacttcctacctcttaaggcactttcctcattattttgccatataatcttgaactgcatgataagctgtttaaatgtccatgacttctcccagagcaactagcaaagtatatgacattttgaatagagattagtggaaaggaaaatgtagagatttaagttcagaggtacaaacctcaataaaacctccttagagcacataccatgagtagagtatatgtaaacgtatatgagaagagagtcgctataatagtcctctctaagtagattagttcattgtctaatggaagtgaacatctttactcctgttatcaccatagtactgaatgaactgtataatgagtttttcaaacaagtatttaaaatagaactttcacgtacaaagcaagggcataaagattttggtttgtgtttctgtaagtgtagtttaccatctaaagctttggtttttaattttaaaaaaagcttcaaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagataccatatcatgaattcttacatattgtaccttttgttggtggttaaatcgcatcagatgcttggcattgctgccataattataaaatgcttgtaaaggatcaaatatcactaaatactttaaattgttttacttaagagtctaatctgggaagttttcaaatcatactattaatgtgtaatctaagctcttcagatgtatccatgaataatcctggaacaat

SEQ ID NO: 16950 - DNA, 1194 bp, Homo sapiens
ctcccaaagtgctgggattataggggtgtgccaccactcccagcccaatgtaagtgttttaaattgttccgctgagcagtgagatttatatgcagcttttgtatacagaaaagaccctccatcagtgaatacttgtatcaacaggaaattgtggtcaagaaggaaccgccgtataacaattttgacgggctcagtagaattctgttttgttaaaagcaggacatcataccacctgtgttatactttaaacattttgggattttttccatctaattcatacatatgtagtttaaagggtttttttctgtcttaatgtgttacatgctctttgggaactggcaaacaacaaaatgaaaaaaatgtattcccttatattgacaccccaagttataacaaatgtttataactagtatttataattgatacattttaggggaaataatctacagtatatctgaatctatattataataataaactgtattatagcagggtcttattttaacaaggatatagtttatactactttgtaatatttattttctcttacttaaatgcaggttttcttagttaaaaaaatctcaggctctgatgctaggcagctttatgccatgaaggtattgaagaaggccacactgaaaggtaagtgttgctgctatttgtaatgttcatgtagtctaaacaaactgaaaggtctcaatagagctcatgggactccttggcatgttatttacattctgaataggttcctgttaccagctttaaatttaggctgacttttagtgaatttttcctgctaggctaggaatcatataactagtgagaaccagagttgccacgttataaaagacgtattataaattcatattgagttttatacaagtaaacatttagaagattaaaactgggtttgattcatcttcaaatttatatatttattttaatgtttttaaaaacgtactgatttactggctgcaaaatagcttttattctaaaggactttatgacttctggtctccaagtaagtttttattctgagcctatgatttgaaaaccctaatgcaggatttggctctcataggtaaaaagtagttaagaagaggccgggcgtggtggctcacacctgtaatcccagcactttgggaggccgaggcaggcggatcacctgaggttagaagttcgagatcagcctga

SEQ ID NO: 16951 - DNA, 1168 bp, Homo sapiens
agcggtttctgctgctgcaaagaagaaagcggaagcctaaggtcccctaccccctccgtttctgaggtcgcagagctagacccccgtccctgtgagtttaacttgagtttcctgtccatggaggtgagagggtgatattcaaggagatcagcggccgccgtaaaaggctttctggttttcctcgcccgggatctggtgaccgtccctgagtcacccatcctagtgcccaaaacccaaacaatatacccaaacagggcaaaacagaatttccccgggcgcatcactacaccgagctttcctgaaccgcccctatcccagaacaactcggggtctgcgaaaataatccagacaagacccgttccaaggtatcaccgctcctctccggagtggaaaatcaattcctgatggtggcgcgtctgtgattcttccttcttgactttttgctgccttctctccccgcagcggactttaggggattacaggatgataggctgcgtgtgtgtaatagttactgagtgagtgaccccatttctggaaagcatgactgaaacgcgggggtggaacggggcaggctctgatgagtggtgtgcttggcggcagccgctgccctgccggcctccgcagtgtgagaagtagatagggttactggttacgtcagtaaaaccgaggctcagtttaatcttgagatgcgggacacttgcattctccggtataatggagagggcgggggatcagttcaaatcgcttttcactttttcccccagtcacctccgctgctgtataacaattttgcttgttctccttaacgcacgcagagttgtaatagtgcttatgattggtgcttagtattttgcgacttggatcatacttgtaaaacctgaactaaatgctgctcttcaatggaaaagacattgatatatgttgaaagaaaaggaaagaaagaaaggaaatcatgtttttaagactggcagaatcacaagaactttatttaaaattgttaaccagactaatactataaatattttattaaaaagccaaatttatgatgtttaataatcctttagatgggtagtgtgaaaaacagtatgcaagagctcgtcatatttttccccagaaaattttttgcattaaataatatagctaaaaggttaataaaatgttcgcaaag

SEQ ID NO: 16952 - DNA, 1248 bp, Homo sapiens
gacagttttagtgaaataaacaagttccttgaaaagcacaacttaccaaagttagaaaacatggcagattatctccactatacaatggtagcttttaataattaaaacaatagaaaaaagaaattattattaaattataccatgttaatatttaagctcattttatcacaaagtaaagctgaaatacgatgcagacaatagaagaggtagatgaaaaaggatggatgtctataacgtcaaaagggctttcataacgatataaggacaagatcaaaacaatattatgtaaatgagcaagtgcatgagaggaaacaaacttttttattgggaatgatattcagattctttagttatcagagaattataaattataaaactgcttaaactagtgctcatgctgcagtcaaatatttgaagttcatgtaggaaaaagaagcagagttactgaaattttttagccattattttaaagctatgaaatgtggctgcttagtgaatttgctagtccatgaattgagagaaattgtaaattaacatgatttttttcccttttgacaggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggtaagtatcgtcttttcgctttaaataactatcgaaatagagatgcaagataccacttatgatctagtgtaactcctatccataatataaatatgaaaataaattaaaagtctcataattttcaaattacctgcttacacaaaaaaattaataagaatacagcaaggaattgttgaaatatttggtagtagttgtaatattaatggtaaaagagaacaaatgaaccatcattaagactgtcagcaattaaacagatacgtgactgtctttttaagatattaaatgattgttattttcaaagaataggcatgctgatttaagatctctataatgtataagtaaattgcattctaattatatgcaaagtgtttccctttccttttcatggccttcagagcctaaccaataatatccttttaattaaagatataagacctttctgaatggtcactgtgatttcttaatgtgaagaataa

SEQ ID NO: 16953 - DNA, 1194 bp, Homo sapiens
atttttatataagagactctaataaacagtgtatttctctttagcatacaaacgactagatggttcaactgaatgctgtaacaatcacagcctcacagatgtgtgcttttcctacagaaataattttaataagcgtttggtaagttgtccctgaagcagtcttgcttgtctgatataattactaaaaaataagcatatagagctaaaatggaatctatggaaacttctctcttttgctctatttgtatcattttattaaaatctctacatttcacatgtcacatttcatctgaaaatctttaaaaatttatagtgataatatcttatttgacccaaatggggtacttgaatctattttatagtagatgcacataaatggcatttcttttatatgaacctcattcctgatatgctaggtgacatgaaaaatattgaaggaatgtaacttaggtttttcttaatcatttttaatattgactgattaatattttatttatagcatacatgtcttcctgcccggaaagcagttgaagcaactcaagtttgcagaaccaataaagactgtaaaaaaagctcaagttcaagtttctgtataataccttctttggaaactcacactcgcttaataaaagtaaaacacccacctcagattgatatgttatacgtaggacatcctctgcatcttcactacacaggtgagtatttttgtggtagacccttagaaaatcattaagatcacatatagtctcagtggtagagactcactacaaatccttgaattaatacatttattataaatttgatcatttatcaaagtcttgttaacttgttcttaagcattaagtgaaaattatgcagtaggaaaataatctgaatttataaagtaaggtggagctgaatccatgcctgcctatggagagtgacacatttttccttccctaccatttatgcccaggtcaaataggtgatctctcagatgtcctctgagagtttattaaatttatacaagctccccaaaacaggcaagagcaacataccctagagaatgccaggatgcatggggatgtaactgtaatttatgtgtgacacatgattttcatatgaatatactttcaaaactgggccagcataatcattttagcagtggcagcatcattggactaagttctttatggctaaagatcatgtagtcta

SEQ ID NO: 16954 - DNA, 1656 bp, Homo sapiens
actttgtaaggcccaaagagtaattttccccttatttcttattccttccacattcctttccctgttgtatcattaaaggattagaaagacttagtcttcctacgagttcattatagattggcttagtttataagtggttggcctttatttttctagtcaaggtttttgaactttgaaataatataaactcattttttttaagtagtagagatctaagaaggaatggcagagatttaaagaaagtagagaagtcaagtgtaatctctaattcagtcacagtaaaatatcttctgactcatagaaatatggtttctactcagacctctcacagttggttccttaactgattttaacccaggtacctgatttccctctcaggagctctggctattgttaatgcagtaccctgctttgctttggatggacaatggattctaaactctttcttggatgccacccttacctcagtgattggagacaatgatgtcaaagatctaatagggtttttcatcttgctgggtggcagtgtacttttggctgccaatgtgaccctgggactctggatggttacagcacggtaatgtttgcactcatctgacagaatccctgagttacagtatacagctatgtggtaatattcattgccattgaaattcttacttggtatgaaatataaagtgtttccttaaaattacatcttagccaacaaccctgagctcctcccatatccagagtacccaaactctgtggtagaagataagcagaagaaatgaaaggcatagtccctgactatattctaatttaggactgaatgtacccagatgcttgtggaataatatctaagcaagtgcaaattcatgtaataccgttttgtctgattacatattgtgttgaaatagtataaaggagaacagaactgggtggaattaattgggaaaaacttcttacaaaagcatcattaatcaaaatttgaaggagaccagactttggccaagtggaaggatgaccattgtcttggcctgtatctcttgtcctttgtcttgtttgaaaagtattttaaaacttaatggtgtattattttgtgctctgaaagctgaggtctgattacaattagtaaaattctatagaagaatctgctgacgtgaaagggaaaaatctttgtcaaatgataccaaataaatgaacaaaacaggaagtagggcctatgatatcgtgagacatgttttgccccacaagagttgcatcttttataaggtgtctctgccccctcataaagcagcactagctttgacatccacggtgagctgcaggaagcatcacacaccagcagcatgtgagcagagggaggcagttggggttgaacttcggaactaggccgggtctcctgacagatcacaagacaccccagaggatcttcagcagtcctacttcccattctctatagagctttgaagcttggaacccttccagggtaaacattttctcttgtgctgctcaggacatctggggcctagctcctgggttcctgtctccaagaagcaatgaccttaaactctgagccatactctgtcctcaccagcggctcccatgtttttctgtgtcaggttattaagtacctagtccttgttttctgtctctctcctaagctacctctct

SEQ ID NO: 16955 - DNA, 1284 bp, Homo sapiens
ctctgtaagcactaaaactttttaatcatttttaagaaactttttagattgtattacaaatttgccttaacagtaattagatgttgaatataattttaacattttattaatgacttgggtcatcagttaataccagtactaaaaccatacgaattattggtttattccagaaaatacagtatttgttctatttttaggtagacaatcatttgggatcagagtacattagcatagtaatgctcagtcagacctgttcaagtagtagagcttggagaatgccatgaaatacttatataattaatttgattgcatgaactaagcaattttactaatgaaaaggttgtatatgtgcaagtcacttttttaaaaaccaagaaaaaactttaatagaggaaatcttattcattaatttatttttctgagtaaaaaaacgaaacccaaatctcattttatttcaactgttaaacattttgatctgttgacccataggatcaggatttgggaaccactttactaggaaagagcagatcagtaccatttgtataaaaccggcctcattatgtaagaaagaaaatgttacgtgttttcttctttagcttggttgtgggcacttctacagcaaggaccatatcatattcatctttgcatccctggcacagtgcatgagacataagtacttaataaatgcagttgaatggataatgattagtgttatttatggattagaaaaagcatgtttctatttaagtaagctgtaaaaagtattattgaatatttactgtaaatatatgttcacataaaaaaataacttggagggtctttgtgtccctggcatattatcatcttcatggaaagaatccactgtggtttctgtagagtgattggaaaaatggattattttgaggattgaagaaagtgttctttctgcgttgtcactttgttcaacagtaaaactttattctcagtgttcctactctgcattgtttacatttttgacagttttttttaatcacctacaatctgtaaagaatgtatatattcttttcagcatctcagtttgaaaagacatgcagttaaacttgaccttttgataatcgctcttacaggtcattgtctgttctaacagcaaattgtaaacatgtgcttcatagatattgtggctctcagtcatcactttgtcctatggtatttattgaatgttcacatactaatggtgcacaggtgtttttttctataaatcttctgactgtcctgtaattcattcttaagctttaacttgaaggt

SEQ ID NO: 16956 - DNA, 1154 bp, Homo sapiens
tccccaaaaattgacttagatattaaaatttggtgcttataagagagagttaaaaaaaaataggattgcttcaattaaaattacaaaagagacattttgtgtgttctgtcgttttatttcagcccagtcccctctttctgacttgtgatctcatagagcaacagtatctcctggtctgtttttagttctgtcactcgatgtcatttatctctttataataggatggccccggggccttttttgaacagtagtaatgacttcatttgccaccgtgctaaatgatacacaacctattacattcaccagtccttcattataccattgacctgaggctagcaagagattttgtctgactgtaaagttgaaagtcaaaagcttatttctggtcccactcttagcagtgtattagatgtggaaataaaagtcattttgggtagctgctatgaaactttctgagcagattcttggctgcaccgatgtatgacagaatttatggagaggcctatggcaatatgagcaacttgaaaactcctaaggaagtgcaggtagctaacagcttggtgtggtgtgtgtgggtaacaatccacatcaaaagtgagctttacattgacttggattgttagacatcagtgggttattctgttgtttttataaaaggtttatactgtatcaatggaatgagtcatttatgatgaatttgcaataagcaaagcattaaaaatgaaatattcagtgtccattttgaggtagaattggtgtcaacacagaacgttcttcctctcaaggtgtaggaatcaatagtatggtatttaaaaaaaaaaaaaaaaattttttttttgagacagcgtcttggtctgtcacccaggctggagcgtagtggcctgacattttttttcttaaatgagtgaatgtctactttttctttttctttctttcttttttttttttttttttttttttttgagacagtcttgctctgtcgcccaggctggagcatagtggtacaatctctgctcactgcaacctctgcctcccaggttcaagcaattctcctgcctcaggctcccgggtggctgggattacaggcgccggccaccatacccagctaatttttgtattttttagtagagacggggttttgccatattggccaa

SEQ ID NO: 16957 - DNA, 1182 bp, Homo sapiens
aggccatgggagatagattcaggagacagtaagggatgtggaataggaaagaaaggaatggaaatatctgtcttttcatttagggtgataatagtgaattttgacccaactcacttctttgtgttggagaaaggatgatgtatgttttgaacatctttgttactgttttaaaacaaaagcatgcaaactgaactctgaaaactgaaaatcccctctgcttttgctgacttttaaagaaatgttataagatctagcattgttgttttactttaatggctgtagtgttatatagtattacagtctcctttataacttaaactggaatatactgtagtatcctatagctgctttttaattagagacaagacaaatatgactgtttaaaattccatttaacacatcagcagatgtcaataatttatttaaaaagtgaaatgctgctttctcgtagaagtgtgattgattgaatattttagagacttgactaatggtgatccagcggggctagaggaaggctgggttgacagtgtttttaatgggctggagcagtgctgatgtcgaaataaaaatgtgctagtacttcctgtacagtctgcatagtcacttccttgcttgcattaactattgctgacgcaagactttgcatttctaccatctgtctcagtagatacatcaatttcattctggtcccatgactcctgggatagggtggggaattgtgggggtgtgggttttatgttaaatatcactggcctgtgttcaaggctctagagcaggaccagtcaaaagtgtagtttgtcaaccagctctttgttttctaagcgctgcacttcagctgacctgtttttcacagcaagactctcattgaaagaagcagtgtgctgatttttccccgtggcacaagctccttaccacatcttggagcagcatttttttgagaccgagttttactctgtcacccaggctggagtgcagtagcgcgatcttggctcactgcaacttccgctagagttcaagcaaatttctcgtgcctcagcttcccgagtagctgggattataggcgtgcgctaccacacctgactatttttttttatttttagtagatacggggtttcactatcttggccaggctggtctccaactcctggcctcaagtgatctgcccgccttagcctcccaaag

SEQ ID NO: 16958 - DNA, 1528 bp, Homo sapiens
ttatatttaaaatttatttataaattaaataaatttatttatacatttataatatattcatgcatacatgcatgtttttggttttttgacaaaatgggatcatattccacatattgttttacaagttcacagaaaactttctttttactgttatttatctggggggatgggatcttgctgtgttacccaggctggacttcaactcctgggtttaggtgatcctcccacttcacccttctgagtagctgcacagaaaacttactgaaggcatataattgtaattatattatcatacataaagaaattaggctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaattttttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggggaaaaaaaaaaaaaaaagaaattaggctggggctgggcgtggtggctcacgcctgtggtcccagcactttgggaagctgaggtgggcggatcatgaggttaggagtttgagactagcctggccaatatggtgaaaccctgtctctactaaaaatacaaaaattagccagacatggtggcgtgcgcctgtagtcccagctactcgggaggccgaggcaggggaatcgcttgaacccgaaaggcggaggttgcagtgagccgagatcacgccactgcactccagcctgggtgacagagtgagactctgtctcaaaaaaaaaagaaaaaagaaaaaaaggaaattaaggccgggcatggtggctcatgcctgtagttcaaactactcaggaggctgaggcaggagaattgcttgaacccgggaggtagaggttgcagtgagccaagatcgtgccactgcacactcccagcctgggcaacagagagagactccgtctcaaagaaagaaagaaattgcac

SEQ ID NO: 16959 - DNA, 1234 bp, Homo sapiens
aaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaatttttgtattt

SEQ ID NO: 16960 - DNA, 1551 bp, Homo sapiens
aggaagttgggattataggcttgtgctacccatgcccggctaatttttgtgtttttagtagagatggggtttcacaatgttacccaggctggtctcaaactcttggcttcaagtgatctgcccaccttggcttcccaaagtggtgggaatacaggtgtgaagccattgcacctggctatatatggattttattagtgtgcctaaaattttactttcatgtatgtattttttctgtgactgcctcaattgctttgttctcctaatttttaaaaatctattgatttgagatgattacaaaagttcttgggttaaaaacatgtgattcaaaaatagattccctctttatttctttaatctatcttaatgtttaagaaaactgaggagctaatctgttttcccagtagaaattaagtaacatttacgttaattgtagtcatgcatacttacctgaaatttgtcattttaattttttttttaaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttcctgtaagtcttggggtacagtgattgtcaaaggtgtttttgtaggctgcctcttctaatttacatcaggggtgaaattttcttgacttaaatgtctgtaaaagtaaatctcatagacctacctgcattgttgtttccatttgcagcctacaagataactgaaaattaagaaaagtgaggccgggtgtggtggctcatgcctgtagtccgggcactttgggaggctgaggcaggtggatcacctgaggtcaggagttcgagaccagcctggccaaccaacatggtgaaaccccgtctctactaaaaatacaaaaattaaccgggtgtggtggtgggcgcctgtaatcccagctacttgggaggctgaggcaggagaatcgcttgaacccgggagccggaggttgcagttagccaagattgtgctactgcacttcagcctgggtgacagagcaagactccttctcaaaaaaaaaaaagctgaaacaaa

SEQ ID NO: 16961 - DNA, 1596 bp, Homo sapiens
gggtgacagtgagactccgtctcaaaaaaaaaaatttttttttttttttttgcgaatagtaacattttatttaaatatctgttactatttgtgatttatttccttcctttttagtggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtaagaagaagtgtttagacattatacatcctcatccaaatgtttcagcctgattacttttgggttatttagattgagaacatttggagtctcttctgaagtaacttttatgtaagaattccggtgtagtaataccaaagtttgtaaaaagtaataagaaaattatgtaaaaagaaataggtggaaatgcagttttcaaataaattattgaagctgtcttcttccctgattgataggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaagtaagtaggtggcctttttgtgggagaaaattttatgtttctggagcttttaagtggccagtgtttgaaataagtagcattattttagagattattatgctactacattccaagggaaacatctttgactcttttatatatgcttatgatgttgctttaaaaccaagttatggtgaaagccaagaagtaaatgattcattcaacaaatatgtattgagtgcttactacgtgaaagctatgttctaggtatgtaatatttggaccatctttccattttgtctattaactgaattcaaataaaaacgtgtttcctgtgatctctgtaaacctggtcacagaagtttttgtaactttctacttagatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaagttgcccagcagctcttagcattgaagaagttggttcttaaacatgaatccatgattgaaaaatggtttctgtggtcttaggtttcagaagtctgaaataccagtatcctgtaaggattatttgaattgaattagagtataaagtctactttttgtctttatttttaacaggaatttccttcatgtgtatattatgtagaaggaagtactgcaagaagtacacaggctttcaggctgaaagttttcatcttgattatgtttggcccatgactttttcattttgggagacaacaagggagtccatggcgcaaaaatgctgacatgtgttttttagctttggaagctaggcgtttcctacggtctcgcgataataaatgtgctcataaaacccatgacctagaatggggaatttctgtcattcatgagtatcatg

SEQ ID NO: 16962 - DNA, 1161 bp, Homo sapiens
aggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgt

SEQ ID NO: 16963 - DNA, 2101 bp, Homo sapiens
ttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgt

SEQ ID NO: 16964 - DNA, 1755 bp, Homo sapiens
cgagagatatttcaaaggtttcatctagaaatctggctgattaagccaccaaacttttgttcacaattgactaaagttcaatggcttgtttccttttattttctttggtaacactctgatgggttagtgagcagtgaaatggccaacaggtagcaatttcagggtatgagagtcaagggacatgcacaatccatcacagaggaacctccccgtgataactgggaggagacctctaagaactacacctacaattgatagatccaactgagattgatgctaaggagtagggcgagccttagataaaaatgattgaagtctacgtttctcttaccctttcaggtactccctccctcttcccccagacaaaaactcttcaaattaatgtgttttctcttctaggtcattttaatgtcattcaacaaatacttactattggatatagggaggaagagagaaacagaagagttgaggatgattccaaggtttttagtctgagcaaccggaaagatgaagttgtcgcttcctgagatggggaaggctgcttgggtagctttgcactgtgtcaacttggctaagctggaactatgtttcctagaattgcctttcctctggacctgtctcctgaactagactcataacatcatgagtattatatgattctggggtgtagggctggccaaaagagaaatttttatgagatctggaagtcaggattgaagcagcagccattacattctgaagttcagtgtcaggtatcaggcaccactgcagctcacacatgttgctcatctactggctcaccttgatgggagctggggagtaggcagtagctgggtccacagctccccgagctcccgctggatatcctccttcagcttttctgagtcctgggccaggtgcctgtgcacctccatggcaaagggagccagttccttctgcaagtcacctgaatcatcaaggttagaggcaatgagagccagactcaggtttgtcctcgctggttccagttagcccttgtgtgttccagatggtccttgttctcgtgcttcatgcccagcttttcttccttgctgcttgctctactgacccccagtggtatcaggttcatgcccagatgcagaagcaacagccctccatagacttcttcaccagcttccctttgtgatccctggttaatgacttttctccgaccttccaattgtcctcttctacacatttacttccctagagtctcccatgatttgtggggtctggtcactataagcaaatgtaattccatattacttatagtgattccaattcctaattgaaccccactgatactctgccaaaggagcaagtttgggtaggagataaggaattcagtttggacatgtcaaattgaaaattcccattcagcagtcagggggagattttgaataggaagcttgaggttatgagtctgtagttcaggggagaggtccaggctggagctatacatttggaaacaattagggtgtagatggtatctaaagccataagaccagatcaggtcatcaaatgactgagtgtaaatagagaaaaattgtctaaagaccaagtccagggatgctgtgacattaagaaaacaaagggcagataacataccctgaaagaacaaatactaaacgaagaccaaagataaattattgaaatgagcaaaggttcttaactgttgaataaatctagaaaatttggaaacggttattgacatttaccaggcagacgaacaaaaat

SEQ ID NO: 16965 - DNA, 1089 bp, Homo sapiens
tggacccctctcttccagggccataggcaaaacacaacactttcccaaatattctcccttccttgtttttgattcaagcaaaaacaacttacaagagaattgaacacttttgccattagtaaccaccagaaaacacattgagcttcaaattattcaataaattttgacagaaaaaagtcaattgtggttgtctctggttttcactgaaatgggagtggtctgtcttagaagtagaccccacccaaagaccagcctcacaacttcatatggccccttccatcagggagagagaggcccccacacctcccccttcatccccatccatggagatgtgggtcctttaggtgacccattaggagccattggtactgaatattccagaatgaaaaatcatgtttggcccacttggttatcttcatagttaaaaagggactatctaattaaatagtttctttttaattatgtctggcataatttataccattcaaaagtttcaaaaaataaagagtgaaaagtaaacttttgctgacaaagaactgttatcctccaaaatatacaaagaactcttaagactcaacaataaggaaatgaacaacctgattaaaatatgggcaaaagacttgaatggatacctcaccagaaaagatatacacatggcaaataaccatatgaaaagatgctcaacatgtatgtcatctgggaattgtaaattaaaacaaggaggcccagcaccagtggctcatgcatgtaatcagcactttgggaggcctagatgggcagatcacttgagcccaggagtccaagaccagcctgggcaacatggtaaaaccccttttttacaaaaaagcacaaaaattagctgggcatggtggcatgggcctgtggtcccagctacttgggagactgaggtgggaggatcgcctgagcctgggaggtcaaggctgcagtgagcagtgatcgtaccactgcactccagcctgggcaacacaccaagaccctgtctcaaacaaaaaacaaaacaaaaacaaagagataccactacacacctattaggatggccaaaattcaaaacactgaaaataccaaatg

SEQ ID NO: 16966 - DNA, 1402 bp, Homo sapiens
accgttttaaagtatatataagtaattaaatggtcattctatttctgtagtaattgtagaaaataattctgagatatggcaagggtttttgaattatcactataatgaaatactctaaaagtcctggtcaaaacagaggaggttgtactcacaaactcactatggatattctcattattttctttgtagagacaagatcaagactaatagaactttctagaggactgaatgctgtggtcctctctgtgaagaaagattgccttctgcaagtcaaacagagagaactgctttctcccacctgctctgagcgtggcatcacagttattcctagtgcttaaatgtgtattttctctctaccacctggactttcccaaagagtttttcctgtagctactccagatcttccactaaagtagtaactttttaatgacatcttgctgtggtgtgattgatgcctgtcaccgaagagcacagagcctccttacagctcttgtgccctcgtactctccatcttgttatcatagcatctgatgtcttcagtccttccaggattctgtgcgcctttcccattccagatacagcagatcgtactgttgctccttgtgaccaaataccatatttgtcccaaacctccacctagggccctgggaccctgaaagtggaagacatcaggtggccatgccctgatgatttagtcccagagccctccgtctctcccgtgcctccctccgccactctatgatttagacttttgccttcttccatctgatcggattctcattgtgagatgtggtgactttcatgttagatcttcttcattgatgccttggttttattttaaaattcatttgtatatgtctgttgattaaagcattcgaaatgttatcttagaatttttcacccaactgcttggtttcaaagatcttaagtgaaaaactgcctcctggtcaataccaaatttgtacagagtgtgaagtggagtttttatgcttctgtcaaacttccatccatctaatactgtacctgtgtcatattttattcctttgtagtcttctaaggaattggaagtttctgtatgatgcgctttactagttgtaaaatagactatcagagggaaaaggcctctctagtttatttttgaaaaatgctccaggtcttaataattttcattttcattcatcttagttttagaattgtcacctcagtctgattttcacaatcctttttgctaaaagttggaagtgggaattagcagacgatttgggataaggaaagaggaatgatgttatatttacccttaggaatagaagtgaccgaagaatccggattgaaaccagcatcctatatacagctccacaggatgtgcttctcttcatggtaattttccatatatatcatctac

SEQ ID NO: 16967 - DNA, 1064 bp, Homo sapiens
ttgggtgcttggaacagtacgccaggtgatttgtattatctcttttgaggaatttcttcagtatactattcctcaaagggtaagctctaaaccccaaattatctgtagagcaagttaattccgttcaggagagggtttcttttgtgtgtttccattttggcatagttagaggagataatcagatggatttggcagcttttaccaaaaatgacaggcaacttaaagtggatagctgtaggtaattactagagttatttagacttaattctgtgtctgaatgaattcagtgcttactgccagccctttcatacaaagactccacatttgagagctgatgtttttatcttttttgcagactggattacagcttcggttgggttttcttgcatatttacaaatgtattcctgttgctgttacttacgaacaataacttggctggctatcggattcttggatcacagcctttttccttgaattctctggagacaggatgttattgctactttatggttgtccatatctggtggtgctgacaggtctgagtcctgatggatttttcttccccttttgtagatgacctgattgtttgccctggatacttgaattctttgtttatccttgaaatttagtaacttcgttggagtatatctcaggattgactgttgtctgttgcctttttctggaatgcagtgagcattagatatggtcatttcaagcctcactgcgttttgtatcagtttagtctgttctcttcttgaaaacttcatttttatattggctctctgtcatctgtccttcacagttatctttccttagatggcactcatctcatctttcttcattcatgctgtatgatttttttctcaagtcttatcctccatttcactgactgactcagttttctgtactgttgattctagggcttgttccttgtaatgtggcttccacttctgttacagttttatttattttattttattttattttatttttttcaagatagtgtctcactctgtcacccaggctggagtgcagtggtgtgatctctgctcactgcaacctc

SEQ ID NO: 16968 - DNA, 1164 bp, Homo sapiens
aacagcacaagtatcaacaatcacgtatgtactgagtaatatttgccctccagttagcaaagtcaagaaatgtctaactctggcacacagcactggttttaactactctttagttcatctttgccttccaaattggttgaaaatggcaagcttagaatggaatgcatattaataacagaaccacttaatgttttaaaatattcataccttgagattctttttgagagaaaaaagaaatcttaacatccaattctagttgttttggcttttcacatatgctagacatgaaaaaggcagttacaaaagtgaaatccgattggaagtcagtggtgtccgccattgagccgtgctaaatgtcgtgtcacaaaaggagtttgtgaaaacaggatgagtagaaaatgttatactgttgtttctatcgtggcaccgctttcttataaattccatttgctttttgtcatctgaactgttacaaccatgggaaacctcagtccatatttttaaaagcactatatacttacaggaaaaaccgacttatgccttcattgaaaaaatgttgaagttaatatcccaaatgtttaatgagcatgttttagaatatttacagctaaagtctgtcactttagggatttgacaaaacttgagactgcctgccaccgaagagggaccaggcagaatcttctcagccttgtaaccagcgttaaaaaaatataaggggcttgatgagatcctagatctgctccttttctcctaggtgcctgggtaactcctggggaaagcatcatattaagtccttttcaagcaaggtgtgtgattttgaccaatgaattgagctgatatgtgattttgaccaatgaattgtgcatctatttaaaaattaccaagtgtatcttgactcttgagtggacagtcaaggcaaagtttacttaggaaatgtaaagtatggagtgttttaaaaaattcaaattgagtttattcactgttggaggaattgaattctattgcctccctcatttccattatgttcattgttacaattgtgctgctctgttctcattgtgatgcttagttctcgtgtagaactgagtgctacattgtgattagaaactggagttgtgcttgagtcagtcctggaaaacaggacccatttttaagaagaacgga

SEQ ID NO: 16969 - DNA, 3566 bp, Homo sapiens
agacaaagccttgctttaggctggttataaaaggtcatctagtgtgaaccttaactttttattcaaaggacagttttgtcaagaactccacgtaaggcctgatgtgctcctggttgtactttctcatcactggtttgacttcattgttttgcagaaattaccttaatccgtgggaactgcaacaaagaaaaacttcctaatatataaaaaagaggagctgctttgctttgcctccaggtttagcggacaagaaatgtctcctgaagcttctccttaaaggatgctattatggaatggcttttcccatttctgaccagttaacagtttcatagacctcaagtaacagtttgaggtatcaaacatagtataccaatagggggtgctacctgcacgtatctgttctatatatgctccaatatgtcatccccgggtgtatcccatgtgcaatatgagtatatagtggtggcattttataatagaccccactcctgcgctccaccataatactcctctgaaatccttggtctcaagaaacatctgttctcttgtgacttgggcactttgtcaagcttattccagattcctgtggaaacgttttatcccaaccaggaaattagtattttgttctcgtggcctcctataacatttttgggtgaaggagaactcaagactttttacagagaactgtgggctcagttatgatctcagcatctgaatggtctaggtagtatcaccattatctctggccctaggtttgccaagtaggatgaagactctaagtgttcctgctgagttgtccaaaggtcctgctccttagtcacctgtgcgaaatgagcagggagagttaaggcatagaaccaaactctttgggttattgtatgggtatgccagtaaattcagacacagagctggggtctgactgaatagaggcccaaaccagcaacttgtaggcagagcccagaatctcttgtgatagaaataccccttttcagaggccttgggaaccagccttctaggtgacaaggggacaaccagtgaaggaaggcggcatgtctttccccttcttgttggggttgaactacctccctatccacttggagatgagtgctgtctgctgtgaagcaaaactatgaggctgagctggcttggaacctctttgttcttggcactttccttctccaggactctgggaagcactcatatgggacagagggctggcaggaacatggcatgtgaagaagaaaacttctttttgcagtcaagggccacccagaatattgctcttcagagagggacaagggcctcattcttccatttggtctctgtcttccatcatgcactcaggtcaagccatgcaagtctgcctaccatttgagttagttggcacttgtagcagtgaaggatgaggccagccaggcaagggaaggtggcgggaacaagggaagagaaaaggaggaaagaagttcctggagggaggaaaggaggataaagaaaatctgctctcataaaaccatttcaggacctcactttacaggtgagactctcttgggaaggcctttgtgcccctgctccatggcccagggcagatagattcacttttacctgaatcttatactctggagcaaatagtgtatcaggctgactatacatttgcaggccttacacgccatactgacaggtgccacttacgtgactcatcagataatgtcaccattgctgccaattatgggaaataactaatgcctattccagggatgagcccaaaccacacataaatgggttctaaatctcaccctcctaacctgcagtgagtccccccgttccaccctcttgaggctgcaaatctactgagaaggaatgggaaggattctacaacccaacttttgatactttttggccatctctcagtctctcccagcccctacccccacaccacctccctgctcccaggcagagaccgggttgcactttgttagggccagcaggtcaactgtaatggccaagagtgagttaaggctggaatgagaaatatgccccaagcttggaggggtaagcaggaataacacaaagcaaggaaagagattctttttgccctagtgaggaaaggaagcttcagaatgagggctggaggatagcaacttaggactgcagaagggggcagcttatgaagatgggagaaagtgggactgaagttgtaggggagcaggagggtagtgattttccgcttttctttctttctttcttttactttctttctctttctttctctctctctctctttctttttctttcttctttctctttttctttcctctttttctttctttctttttctttctctttcttccttctttctttcattcttctttgttctttcttctttctttctttttttttttttttgagatggagttttgctcttgttgctcaggctggagtgcaatggcacaatctcggctcactgcagcctccacctcccaggttcaaggggttcttctgcctcagcctcccaagtagctgggattacaggtgcctgccacgacacccagctaatttttgtatgtttagtagagacggggtttcaccatgttggccaggctggtctcaaattcctgacctcaggtgattctcccgcctcggcctcccaaagtgctgggattatgagcacgagccacggcgtccagccgattttccgctccctttcaagtgttaactcaccccctgacaggtgaagagggaagggttccttttacgcacaaccaaggttagcaaatgcccatgcaggatatggggtccctgcctctctggttgcttcatttcagcacttctatattagctgcttatggggaccctaaaatgaactggtcacccctccaccagctaagaaacaagggtgggattgctgtgccataagtcacactgaacgacttgcttctggcaagcatgctcctgtgtgtcaggaccttaccaaggcaaagaaatgccaggctcaagaggagcaggacgtgagacattggcctggcttctaacctggtctgagtggaagagacacagcttagggatttcagttttgctcttaggctactagatactgttatttcaccccctgagggagggacaggaagagcacggatttattttctctccgtcttcagtacttattttagcatctagtcataccccagggagagatgcgagacggtgtcactggctcagctgaagcagatgagcccgtctctagcagagatgtgcctgtttcttaggcatccgttcagcactagtcttggccatcagatttttaaaaaagaaatagctcatgaggcatttgcaacttctcctctctagacttctttctagttttcctctgttgtgtcactgcgatgtgtccagggacaaagccataagtagagcatacatacttaagactatgctgtacatataagacaagacctgtctgggttaaagcacgaccttatgcccaagcatttactctggtgctgaataacgcgaactactggaatcagcctcccccaactctgcgcgccccctgcccccctgctcctatc

SEQ ID NO: 16970 - DNA, 1197 bp, Homo sapiens
ctgttacattaataatacataaaatctttttataaaagggaactgtcattatctttggtcagggtaggacagttgcatatttttagtatgtaggtctaactgactaaatatttaaaaacgtttacaggcagttccttcaggaaaaattgcttcccctgtctccagaaaggagcctccattaactcctgttcctcttaaacgtgctgaatttgctggtaagtgtgatgtcaggcagaattgcaagagtgttgagtggtttctgtcaaaaatggaggccctatgatggaggaggtagaggagattttgaaggtgttgtgatggcaagtttaaatgtgaagatttgaattcataaaaatttcagtaaaagttaaaaacacccaatttggagattaaagagaaatgcaaacatagtatagaaaagggacaggctgctattttagtgttggataagcctttgtgcgcctttgtgtgcctttgtgtgcctttgtgtcatcgcaataacacatgacaagaatgtgtgatgatgcctacaggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttgtaagagcattttatgacttttctggcaaataggaccacaatttttctgttggattttgaaaggtttttgaaaatgtgatttctgcagaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtaatcatatataaggtaactatatgcctttaactcagagtaggacttttcccttaaatattttattttttgtttctttttgtgtgttttgtctttttatttaatcagtttatttctgttttttttttctttatccttaaatacttgagtcactgtaattagctcaggtcaggccctgccctcacttaacatgta

SEQ ID NO: 16971 - DNA, 1170 bp, Homo sapiens
gttaggaaagtaggactaaaacatgcagagaagggagtatgagatatgattgttgtgaagttttcccccttaagtgggtggaacacatggaacaaaatggtgatgagaatagcctggaaaatatgtagaagagagcaatcatgagttcatttcaacacgcatttattcacttcctctatgtacgtcactatgtgaacagctgttgtgtatggtaaggaacttacagtgtgtaataggggaagctttggtcaattttaccttttcagaaggctgaactgagtttctccgctgtatgttgcttgcggcattggtggtggtgggatttcctttgaggaagactgctaaaatcttccattctggcttcagtggatagatagcaaatgtttcatcaaagcagttttaacaactgcagggacttagggttctgtgcttgaccattcttttgaggtcatcaacatgaccagtggaagtatttgatgaccctcctaattctttagggttggggggaatatatttaagacagtttcgtttggaaacatgtactatatgattacctgaaattagactaagatgggtgttggaatctttattttttttcctttttacagttgtgtctaaaccaaaggactgtatttttccatatgctttcaaagaagtcattgagaaaaaggtaaagtgctcattatatgaagcatctgtttgtttggagcgagaaagaaaaggggggtggtatggactagtagaaaaaaggtgttttatattttattagattcattcctgccagattggactatgacatcgacccattaaaatgtattagacatacacctagaagcattatttaacaatgtttaaatgttttactacctgaaaataatgggattctgtactgtattggtggttggataggctcaaacccccctccaatagcttaattagaagcttctctaaaatgcatgatcatatgattcctgttttgggaaggtgttgggtagagtccctccccagcttgagggaagctaaatgaagttgggaatactgtggacgttaaagagccatgtattgacaaagttgacatggggttggccaaaatggatcagtgatctctaaattccagcgtgctccatgaagaagttttcatgggtccttaataaaatggggaggagtggg

SEQ ID NO: 16972 - DNA, 1204 bp, Homo sapiens
agatgccaagttcattttgcagatcatgtgtgagctaaatgttcttccattagcattgcagatcactaacatcgctgggaacattatggtaaatttaacttagaaagggggaaaaagcatttcctgttggattcagtgtttgcttggggtagttgttatatgataatgagtctaaatgcatgcttataaaatgagtaacttggattctgaaagctggatttcttttgtaaaaggaagaactggttgggagaaggggaggaatgccaggtgcagcgtgttgaaatttgggtgaacatacggatcatctctctaacatctggatgtgtctttttagtggaatggtccatttgggagtaaataaatagccaagttgtcaatattttaagctctctttgtctcctttagctataatgcttaaagaaaacgttaggaataatttagtaccttttttttttttaaaaaaaaagcagaccgttattaggaatagttttgaaggaggtgctgtgactaaacttactgactcaaagttgcttttgttagttgtggttttgagctcaaatttaaaaaataaattccatttaatagtccaggacgctgatgggtggacgatccgagcgtaacgagttcttgttgcttcatgcattttacgaaaacaactatattgtgcctgacaagcagattttcagaaagcctcagcaaaaactggtgggtccaaaactgtgtagtattttgttttctcttaaccccccccccccttttaatacctagatagccttttttttctgtgataacatctgctttcaaaatagctaatcccttgtgtactaaagaaaccgtgtcaagtttattcccttgtttttgtgtggtcatttccttttccactttgtaaaaggaaaatgcactttgtgcagacaaaattatttgtgaaatgtgaaattctttgagggaagcattagacctctctgatgggtgaccatacatggaatgtgttctggcacctcagccctatccaaagataaatgccagttaaactttttattttcttaaacctatgagcctttatttttgtgttgcatttttctgtactagtatgaccaaggtcacccacagtcaggtttctgaagtagcctccatcactttggaactaaaacttagtttagctactgttttattagcactgatattaattaattcagaaatggga

SEQ ID NO: 16973 - DNA, 1126 bp, Homo sapiens
aatagtcaaagtttgacttctttatttctggtcacatatttagttgttggactgtctattcactaactaactgaatagtttgaaggcaagtactgtatgtatgcattaagtctttacattcaacaaggactgtttcataattttcatatattacctggggctgatccagccagtcctgtcctttggttgcatgggatgatctattattgtctctctctctctcttttttttaatctatttttgtccctgcagttttcaatgtctttgctttatacccaatgtaatatcatgttacatacaagccaagtaaaattccaatgttgtatgacttcaaattctgtttagattaactcttgggaatttgtaacatgttcatcttctccctattagatgtttgagaagctaatactaatatttgaaattttcacaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaagtgagttcagctttcagttttgcttttcttgtttgtcttttaaaaattcaggtgtgaatgatgtagagaatgcttatgaatctgtcaagcccaagaacacttctttgttatttttattattcttattaataagaattattaatcattcttatttggaatggaattttataggtagattaaaacttagaaaaagccaaatttgctcagtgagaaatgcctgctctaagatacgtctcatgagtttttaactcatagtaagggtaaaccttcacacttcagatccttatagagttggtttcgttgatgttggtttgttttgctctattgttgctattagaaagtgccttgttttgtgctcctgaatcttcctagagcctcttgagggacataattgttaagattttcccattttatggcttaaaatgttctgggactcaaaatgggccatggagtgagactttgttcccacccgtatgatttgtatataaaa

SEQ ID NO: 16974 - DNA, 1216 bp, Homo sapiens
atgttgcattttgtctcagatgctgctactgaattttaaccactgaattagattgcaacctacatgctgttaactactgagccaagatgaaatcgactactgcattgaaatcagggttagctgtgtctgcacttgaaggagttgtaatggcagtgaacctgttttctttaatgggatttttattccctgattttattctcagttttaattgtgactttgattttaagagaatttcttagtacacatttatttgaggttttcattgtaactttaagagaataataaaaaacatcctatcgaagtaggtgcttccaaacccatatgttcagtggcatatttctgtgttgtgttgttgcagttacttgttttatttataaagtatctcttgtaaaaagagaagtcatttgtccatgtgcttttgagttcaaatggttgtgtgtatgtgcatgaatttaaaataattttttgtgggagttttcttctttggggtatttttggaatacttttctgaatttgtttttttcttttacattaataggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcggttagttgtttctgtctttcattttgtgagtgaacttgtataaaggccttacccccttcccccactatggggtatataaaaagggcgaaataaacacacacatgttgctttcatgtgtttaaagaattttagcatcatgtgaaatctaccttcacagcttgcttttatttctgtttgaaaactcttacttgaatgtgcttgaatattgttttggcttcctagagtgcttgaccttggtttttaagtggaatcccttaaaaattctaaattatcttaaagtatttttattataatttcttaattagtaacctgtattgtcccactgtcaacccccatctattaagacttagaccaatatttttccttatcttaaatcaagttactgggaactaagtgttttgggaaagtttgtgtttgtctttacacatcccacttacctccattttgcaaaggtactcttatcttttctgctgtctttgcatattagacatttaaaaag

SEQ ID NO: 16975 - DNA, 1243 bp, Homo sapiens
ctccctcccccaatacacttcattttttggaaaaattgccaaaattttagatttgctaagcagacagtaagtgatactgtttttgtggtactacacttttaacttttagactttatttttaaaattaacttgacaagatgaaaacaaactaatgtgataaaggctcttgtttttcttcaagtttgtaatgaataaatacaaatttaaagtttttaatcagtatctctgagaaagaggtttatttccagtaacatgacttcactggtatttacagagggaaaattattttatccatagagtccctcgtatagtgaatgtaaaatagtgatttcagggttttccctttgactttgcactccattatgatgatggcaaggaatggaaggtatgtatgactaaagcggtctttgggaggaaaataattgagaagatagggttaacaactcaccaataaaacgaattaagaatattcaacactaggacagcatgtaagtttttaagcacaaaaacccttttatagcctcacagtaattttttgtatacttctcctgacttatgtagggaacagatatggagcccagcttgtatcgttgcagtaacatcgattgtaaggcttcacctctgacctttacagtacaactgagcaacaaattgatcatggacattagacgtttcattaaaaagtactatgatgtaagtatccataatgatattcttacatacacaacttattgaggtttggtacttgtttattggttttcatgaaactaaaattttgaaaagacttttgggaaaaattcctagtgaaatactattaatacaaatatgataaagtatgtaattttggcatattagcatgacaaattatttgataatttctctcaggcattacatctctttcatttacgagcagtattttaaataatgaaatttttacttcttttagaaaaagccagaatataattaagaaatgttttagtttattgttacctaaataagactaattaaatgattgcttagatctttggataaaggaagaaaaaaatcactattggctattgtcagcaagtagagccataagatcgtgtgtagtgatcttagtggactgcccacacaaaactaatactttgtgtttatgtagcactctaaacgactccataccctagttttttgaggaaatcaaatatcttttaaatttaaatgcagtttttctggcattcaaaagagaatatctaatttttat

SEQ ID NO: 16976 - DNA, 1218 bp, Homo sapiens
caggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaagcagttgtggtgaatccttaccaggtgcaaagagttgactagagaggcagcaaggagtaaaatgtgagtagagccagttgctgtggcacacacctgtagtcctggctactcgggaggtggaggcaggaggatggcttgagcccaggagttcaaagcagactgggcaacatagtgaggcccccacctctaaatacatacacacgtacatacatatacatatacatatacatatacatatacatatacatacacacacacatatatatatatacacacacatatatatacacatatatatatatatgactagaggccatccccttttcaaacctcagcccagtttcttcatagccacctctatcagaacccagctcaggagtgcacagcatgatatttggtcgaatgttctgagaagcattcagaatttctgtgactttaggtcatttaagagatgaagtatggtttcttacgtgctttgctgacttagagagccaagccaagagcccagcagcatctct

SEQ ID NO: 16977 - DNA, 1575 bp, Homo sapiens
tttgtggctgtgaagtttaccaccattggctgaacgatcagtgtaatgatggaaagttcaaagaagaatggtaaaaacatttgtctcatggcaacacttcttgtttatcatggcttgtttctcataggtaaagtgcccacctcttgaaatatcatgaacttcttcatatttgcatagaaagtgaactggagtgatgattcattaaaccgtattctactgtcatattaaattgtgtgcgtttgttggctcatggccagtgtatttgcaaacgtgtgcatagaaacatagtaaatattaagtaagatcacatgatgtttcattcttggacacgttgcttctgaaaacgtagactggtttggccttttacccttttaaccgggaagctttgggtcttgtttaattgggatgaaacagaaatggctatttttaaaaagctagcaaaggactctgtggtgagctgttttataacaaagagatttttctccctccagacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatatttttacatgcagagtatttttgtattcaattaaagaaataattttattccagacagtcacaaatttctctgttccatagttaaagaagacatttgccaacaggtagcatagctctgtacatcttttaaaaaaaaaatagcagggtactagtataataagctattttcacaagtgtagcaatttcatggaacctgctcaaatcaaatttgtacatattgttataataaattttaaggtcttaactattaacttgattgaaaaaagcttcagcagggtttaagtaaggcctcaaaaactattaaaacctagccaacataagcaaaaagtatctttggaagtaacaacatgacattgaatgtaattatgtgccagtatcagtgggaggtcactttgctctatcttcatttccacttccctcagctgtatggaagactgcgtttgcatccaactggagtcaagaagcaatctgtaattataaagacatgcagaagtgaaagaggagattttctgttttattgggggatctttttggtacacagttatggatttaaagatccacaaggaacatacattctataatgaggggttatagttccagaaagctcaacatcattataaaaccactaattacacttcatcttttagatacattacgtttgtaactggtatattgaacaacatggcatgaaatcataaagcaactttattgttatctcctgctgcccctttaatt

SEQ ID NO: 16978 - DNA, 1222 bp, Homo sapiens
ttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttcttacttgcatttctcatttacagactagaacttagttgaaagttaaattaagaaagatgtttcagaggccgggcacggtggctgacgcctgtaatcccagcactttgggaggccgaggtgggcagatcacctgaggtcaggagttcgggactagcctaaccgacatggagaaaccctatctctactaaaaaaaaaaaaagatgtttcaggacatgtgaaacttggctgttagcgcttgatagggcacactctgaagagttaaccaacagccaaagaagtaatttctgtaatgatgaacactttaatcattctattagaagaaactacactg

SEQ ID NO: 16979 - DNA, 1210 bp, Homo sapiens
tcgctattttgtaaactgggattttagaaagcacgtttgccattttgttaaagtacattgccccttaaattttggagtagtttttaaaagtttaaaatggtaatagaggagccagaaactttttaagcattgtaaaatgttttgaattgatattgactttgtttggaagagagtagaggcagggggctttaaagaaacaaagaaatgcattgtaaaaatgtagttttagagcaaattaataatgatggtggggaaagtgttgctaatttgtttatttccctggaagaaatgggaagtgtgataagcagtttaatttttaaggagctggtctcaattttagtactttttaattatgcaaataaatcaatgtttccttaaattttgtcattgctttgtcacagttgtctagggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatgttacttttaaaaatcagaataaattgggcactgtctgtgttgcaccactactgtatcttttcgaaagaattaacagtatttgcctattgtaaaggttaattctgatgacgttttcacattcaccagactttttttcctgtattatttgcatccccaaatatttaatacaagtagattctgcatggcttgggcattcagagattaatagaatgatgactcaattttaattctaaagccatgaaaagttactttgagactgaacaattctgaattatttatgatacccaatgtccatgtttctttccctactgtaaaagaattgatcagtttcttcattaaagcagcaaaaacttattaaatcttgtaaataccatgtctcttttagatttctgtgtatgctgtgaatgaaatcattttgagatgaaattgtacaaaggcattttaaaaggctctgcatgcatcgtacctccaaacagtacatattcggaaagtcaaagattcctgcaaaataaataaactaaaagc

SEQ ID NO: 16980 - DNA, 2532 bp, Homo sapiens
gcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgta

SEQ ID NO: 16981 - DNA, 1143 bp, Homo sapiens
accatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtggaaaaaaataaaaataaaagtgatttcacggatgtggtttgaatttgtgtcgtctctgttgtgtaaactctttagacaacgcttctaaattacatatattcattacattttctccttcaaaatatatattatttagaaaacatcttaatatgacatgctgattttacttgaaaacatttttaaattttttattacaaattatctcccaagatccttctattctccacagcctttgcacggtcagtgataaagggatactattaaatatcttttataaccttctgttttaaaatgtactcaaaggagatgtagtgc

SEQ ID NO: 16982 - DNA, 1859 bp, Homo sapiens
tttgcttttctttcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccaca

SEQ ID NO: 16983 - DNA, 1141 bp, Homo sapiens
ccattatttctaccattaaaatcttgaaagcgaaatacttgaaaagaggtgaccataaagatcacaccaatttagaatgaatattaaagtctgagaaatttacaaaagggactctatggactcgattttaccatatggaatagggatccacttctctgttaacctacaaaacgtatttatctggccattgcacttcggataattttcatttttaattcctcttggtgtcaaatttttaagtaatttcatgcacacaggagaaaatgcaatttgataatcagtttccactacattcggaggtcaagaaagcagtatatattctttcacaaggcatccatactgtttaatatttatagagttcatagaaatacatcaataagctcctaaattatagagcctcaattttggtttttctcatttgaaatgtttttgatttatcaatatttgtggtttaactttgtgggggtgtccaggcagtagatcattttttgtctatttttaaccaaataagaataacactcaagactatgttctccatcccaacacatcacttaccacttgcactattcttaataggcctaaaatagtgagcatatataatcaaaataatacttcatacaacatatacttccatgcactcttcatgtaatcacatatgtgcatagatacacaatcgtattacataaaacacccttgaaaatatatgactttgaataaaataaagctaccatgttaatacatcattttttgtttcttcctaattaacaaaagggctctataatgattaggagagctgtaaggccattctttagtcattccaagtgtatatttgtatcacaccagttacttgtgttcattgacaccaaatattttcaagctttttgtgagaaagagattcttgccttgaggctctgcagtggcaaatggtaggggcaatagcgctcccttttcacctgaaatgccttcagctcaggccttgggagtgaggtgtgggagtagccaccagcctcccactgactaggcatgttaggaattagacaaggatggagagactggttttttccagccttggtttggaagcttgtctcaaaaaccattacaaaatcttaaccttcaaatacattctaaatcactttaattt

SEQ ID NO: 16984 - DNA, 1208 bp, Homo sapiens
cctgtccagcactacaacttaattgctctatgcctcagtttccccataatacccttttccaacctacctcacaaggttatcagaaagatcaaattaaataatagatgtgaaaatgctttgaaaatgtttttaagtgctatgcatatttatagagttattatagttattcaaatccataagcaggttatttttatttttttactgtttgaaaagaaataagtagtgtcattcatatgagttcctgagtggatatgcgaatctttggtcttctcgacaggtgccctttctcttaccactagttgcttacaaaaatagcacccaaacacatggcacttggaagaaaaagacccactgaatctgagaaagtactttctggtggcaaatgaatttatcattttagtatagttttcgataaaggatatagcaacatcttttgataattgtgctttacaacttgaatgctgattcaaggcattatttggatgtgagtttaatcttttcagccttgtaaatgggaaaatatatattaaaattgattgtcaaatacagcatttctttggaaaccaccttaaaacattagtgctatggttatgagtgtatgtgccagtacttaccagtcaatgcattgtggatatgagctttcgttgactgcttctctgcagtcgttgatgctaataaatattgtcctgtttcttcatataataaattaatttttcaatttctccttgtatttcattctttatacaattcttacatggcctttttacttcagggactatttttaaaacagaaattttaaaattgtttcattgtaactgattatagttttataaactcacctggaaattacttctgtaggctgagaaatttgagagtgctaagattcagccttgcagaacaacaacagtccatgaaaacctctctgattgttttatagacatttactccacttgttaaaattacactgctggatactaagattctgttcagttgtccatcagttgccatgcacaatacaaaaaagagaggcaatacacatctcttctagacaaacataaatatatactgattcagaaatataaaacaccaaagaaatggcttggtattaacatacataatcaaatgtaaatggttgggaaaaacatcagtcattaaagggatcatttcagagcatgagagagacatggactgtttcaataattcctttg

SEQ ID NO: 16985 - DNA, 1911 bp, Homo sapiens
tgtatatatatatatatatatgtgtgtgtgtgtgtgtgtgtgtgtgtgtgtgtgtgtgtatatgtgtgtgtgtgtgtgtgtgtgtgtatatatatatatatattctctgataatttttatgttttgctggtatttcaaaatcctttttttgtgtttcaggaacctgtaccgtaagatgggagaaccggaccatgaactgtattgtcaacgtttttgccattgctattgttctttaactgactaaaaatgttgggctaaagccattaacttaagaatttgtcagtgtatcctttccaaaaagagtaatagttgtttactagtgtgctagatgaaaagcgtgcaatatgctttaaagctatcaacaaaaactgaatattataagcaagcaatatcatagtaattggcagattagctcatattctatacagcatcgtttaaataggaaaaatttaatgctagcaaaaaataaatttagaaatatggcatgacatgaaaatacaatcttatatttacaccagcttttcactaatattttgtacctaaggtgatggggaactccattcagataataaaattctctttcagctagagaagttaacaggaataaatatatgaacaaaaaagctgcaaggataaatgtggagaaaatgatgagaattagctaacatttttaagtttttttaaactttcttcccctcagttgtacttaatatttagtggaaagtaataatttttttaattttctatcaactaatagtatagtaacaactatgattaacttgtttactttttctgaggattagtaaatcaattttttttaatttcaaatttttggatttacacttgagggtaaattaaatctggtaaactgaatttcctagttaaataaaattagttgcagtatatgatgaacagtgtatgactcaaacagctgccttacaattcactcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagacttattatgtggggttcaaattgagtggaataaagtatagattaaaagtatacaatccttagcacgttatctcagggcttatgaaatgtaattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacct

SEQ ID NO: 16986 - DNA, 1269 bp, Homo sapiens
ccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaagtaatgcctctgtctagcatgccaacaagaatgcattgatattgtgaacatttgtgatatatgtattaataaatagagcaattacaagcagctgtgttctggttctgttctttggttcttatgaaagttttaaaacacatttcttttccatcttgctcttcaggacatcgcaggcaggtggaccatctcacacactgacacacctctccatgtgtgctcccaccccactaaaatagcatcagcagcagagaagctaaagggttaggtttttttaattattgttatggacacttcagaaactttaaccatttatcatgaacagaatacattgttgtctgtggaaatagagccttcatatcatttcaggcctctgaaatccttgggcctgaaatccgtgaaataaatacaaagatttcagctgagtttttaaagtctggatttcattttgttaaaaaggaaatgagcctctattctttccttcatcgcttctaatga

SEQ ID NO: 16987 - DNA, 1192 bp, Homo sapiens
gttaagttttagagaaaagggatcttttttttttttatttgagacagagtcttgctctgtcgcccaggctggagtgcagtggcacgatctcggctcactgcaactccgcctcctgggttcaagcaattctcctgcttcatcctcccgagtagctgggattacaggcgctggccaccacgcccggctaatttttgtatttttagtagagaccgggtttcaccatgttggccaggctagtctggaacccctgactttgtgatccgcccgcctcggcctcccaaagtgctgggattacaggcgtgagccaccgtttcaggccgagaaaagggatttaaaatgagaagcttgaatcttattgaacataattgtaggactgccagagaggactggtggatgaggaatatggcaagggacatgagatgggaaaaattaaataggctgtggtttggaagtctcaaagtgaaattcaaggtgcaaggctcttaaaagttaaatccagcgattcggtacatagcttaggccctattaaatgacccagtgctttaagaactatcttttgaaaggaacacttcacacaagcaccctcaaaaataattagacacctccccatttctctgttaaatggtgaaagacacccaagactagacctaactactgtcaccctctcctggcctcttggcagccaaaaggccacatggcccaggctctccagcatcactgtgtagccgacttggacaaaaatggacttctccccattgccacttgcagatctcttcaaagaatcagcagatctgatagtgtgcccctcttcatccccggcaaccactgttaaaggaaagattgggaaagatcccaccccgccaggagggaggcaaaagcctctgacgctcccctccccccatagctgaccaaggccagggccactgcgggagcaccgcgcgtccacgtgcacccagcatgcccggtcaccctttattacgtaagagtcccaggatggagttgtacctgctgccggcccctcttccccgacggctaataataaacccgggttcctgtttcccggccgcggccactccagattcggggctgaggggctcactctgcaaccaaggcacgtgcattctggtcatcccacgcggggagcgcgcgcaaggcccgcccagcccccacatgccagccccaccctccagtc

SEQ ID NO: 16988 - DNA, 1141 bp, Homo sapiens
ggtttacatgttccaatatgactccacccatagcaaattccatggcaccgtcaaggctgagaatgggaagcttgtcatcaatggaaatcccatcaccatcttccaggagcgagatccctccaaaatcaagtggggcgatgctggcgctgagtacgtcatggagtccactggcgtcttcaccaccatgtagaaggctgggcctcatttgcaggggggagccaaaagggtcatcatctctgccccctctgctgatgccccaatgtttgtcatgggtgtgaaccatgagaagtatgacaacaacctcaagattgtcggcagtgccttctgcaccaccaactgcttagcacccctggccaaggtcatccatgacaactttggtatcgtggaaggactcatgaccatagtccacgccatcactgccacccagaagactgtggatggcccctccgggaaactgtggcgtgatggccacggggctctccagaacatcatccctgcctctactggcactgcgaaggctatgggcaaggtcatccctgagctgaacgggaagctcactggcatggccttctgtgtccccactgccgtgtcagtggtggacctgacctgccgtctggaaaaacctgccaaatatgatgacaccaagaaggtggtgaagcaggcatcggagggccccctcaagggcatcctgggctacactgagcaccaggtggtctcctccgacttcaacagcaacacccactcttccaccttcaatgctggggctgtcattgccctcaacaaccactttttcaagctcatttcctggtatgacaatgaatttggctacagcaacaggatggtggacctcatggcccacatggcctccaaggagtaagacccctggaccaccagccccagtaagagcacaagaggaagagagagaccctcactgctggggagtccctgccacactcagtcccccaccacactgaatctcccctcctcacagtttccatgtagaccccttgaagaggggaggggcctagggagccccaccttgtcatataccatcaataaagtaccctgtgctcagccaaaaaaaaaaaaaagagagagaaaaatcttggcttacattttgactttgtgaaaattactttac

SEQ ID NO: 16989 - DNA, 1307 bp, Homo sapiens
cctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattgaagtaccttgtgtcccatgtattcctaaagcattattgttgtccctgattcttcttaaatggtgctggtgatgtattccctatagataactttagagcaatttatagtctctggaaaccaaagcagactggaggattttggaggagttatactcagaatataatttggagtcctattctgaaagcccaattcttggacatatttcctgtctcttagaaccttctctttcctgtctcctttgatgcttatggaggcttttgcactgcctttggccttgacctatttcagtcccacgtcatggccaactctctaggagtgttttttctgaa

SEQ ID NO: 16990 - DNA, 1221 bp, Homo sapiens
gtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgtta

SEQ ID NO: 16991 - DNA, 1189 bp, Homo sapiens
caaccagccccgcctttcacagctggcgtccgtagccgggcggaggcacacgaccaggaaagacagacaccctggttggagaccgtcgctcgagactggcagaaagatctgcactcgggaggcaccctcaccccgtgggctccgggacccctcgactagctccatcacccattccgactacccgccctacgctccacctcttgacccgtcatcaccgaccggggggcgggactgcccgacttttcaatcgctgcctaccattggtagaactctccatccgttactttaagtcccgcctatcaggctgtcgcttcccaggttacgtcccttccgtaggccgcggcgtaactggtgattggtggagaaagcggcagctgtcccagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgaggagccgggggccggcaggacgtgcctggggaggtcctgcgccgcggggcttgggggtcgggggcggccgcgggcgagtagctgcgaggcaggtgccgcagtgcggtccgtcagcggcggcctcgcctcagccgcgtccccgtcagcatcttctctggatcggccgtggcggcgcggcctcacgggccgccggggccggggctgggctgcgtagggggcccctgagcctgcctccaccctccactttgagggcggcgcgtccggccggcttcttgcgcctgaaaaggcccttcagagtacggagatgcatttctcagtgaactgggattgagtcgcagcccgctgcgaagaagagaaggcagactttttagctgccactggctgccacgatgtttttgcatttgtatggtgccttcatttctagtggttgtcatcagtaattgctgaaatccctgcccctcccttcccttatgtatatttccggatgcaaaagttgagatggagtcattatttttatatgacttatatttcttaaggcgaatacaaagcacctctcaatagtttgtcagagttccaaattttaaggatttggaaacaggatgtgagtcgcatttttagggtcacatgtcaat

SEQ ID NO: 16992 - DNA, 1642 bp, Homo sapiens
ctgggataatttcctattttaaaattcttccctcttgatttttctttcttttctatattgtagaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaatttgtgtcattgcagtactaaatctattttatattgtaaaaacctaacaaaacaggcttttctttcatcaggattggctgttttgttgtacagataatttcatggtgtttcttttacacttgtttattctcgctgcctcctgagatttagtactaatgtaaggaaggcattttaattaccattcttgttactgaatttatataggatatatgagaaatgcatactttatgtaggaaagggttacatttttctatagcttttttttttttaaattaaaaacattttagagaccagtcttgctaggttgccaggctgaactcctggcctccagtgatcctcctacctcagcctccccagtagctgggattacaggtgtgcaccactgcacccggccctgtagcatttttaaagatgaataagcaactaattggttagaatatgaaggactgtctcaggtaaaggtttaaggtaacaatttgttttctttttcaaaaaacaggat

SEQ ID NO: 16993 - DNA, 1096 bp, Homo sapiens
cctgcgcactgccgtccgccacgccccgcaacctcctggttccaagtgggagacatggtgctgtcggagctagcggcgcgcctcaactgcgccgagtacaagaactgggtgaaggcgggccactgcctgttactgctgcgcagctgcctgcagggtttcgtcggccgcgaggtgctctccttccaccgcggcctactcgccgcagcccccggcctggggccccgcgccgtctgccgcggcggctcacggtgcagccctcgcgcccgccaggtgagcacctggctcggggccttgaccaccgcccccaccccacccctcctcatccccgttcctgtcccagacccagagcgcaagtgtcctgttccctccgcgatgcggggcccaccgcgacgtccctccctcctgggcccctcctcaccgccgccccctgtagtttcagcctcagtgtcaggtgtgcgctgaatggaaaagggagattttgagacatcatgtcaacagaaatggagatgtgcactggggaaactgccggccgggccgctggcccgtggacgcctgggaggtggccaaggtaagcgcctgaggcggggacggaaggaggaagcggcgggtcacccagcactcggggtggctatctggtcttgtggtcgccggggcctcataaacagatgcagagagagagattgatcaagggtctaggcggttcaggggtggtatgcgggacccaacccagcttagtgaagtagaagctttcttctacccgtctgcttcctgagggcatttgagtttgttacccctgcttggaaagttacaggaaagagttctacaagagatactggggcaagatgcagagcgagcatcatgagcacaggcagggagggagggagactcttgtgtggcctgtttgagggtaaggctcgctgaacagctcatcagctcttttttggctataggatgccgtaaggatgacagagtaagccaagggaagttagggctaaaatagcaccttaagtgcccagttaaaggcactttgggtagctgggaatggggtaggcagccggatctgtcttcagatcttggcaatgtcacttactaagta

SEQ ID NO: 16994 - DNA, 1657 bp, Homo sapiens
gcaggtctgtcatttttgaatactgtaaaactgtgataaactttatattgaagctgtattttaatatgaccgctttgaatccttacatgaaatgttctgggagttgttataaacacaccccaaggaagcaatatttaataaaactaggtcaaaaacaaaacaaaacagtgacactcacttgtgtgtatataaactctagagacatcttaggccctcccttcatctttaacctggtggatggagccagttattaatttataataatacatgtctgaaatttgaccaaaaacatcttctttatgtcaaggttaatatattttcttcagacattcctaacttgactagtggttaacatttagcaccttggttgtctttcaatatataggatttgggtgaaaaataaggaacttagtctttgagaagggacagtatgtggttcgtattgatcaaggatcccaaataatgcaatcattctcatctgttgaggatgtgggaacttttctgtcaggaaaatttagtttacagaatacttctgcatacaacattaattaggaaacaaagaactttaatgctgtacctctgcatgaagtttctgtgagctttctttatcttgcttaacttatcctcctttccttccccaccaaaattgggattgttctaaacaatttcaatttaattcattgtcaacaaaacgatagaatgttttgcttggaagaaacctggtccattcccctcattgtgaagaatcccgaatcctgggcctgtccagggtcaaatggagtttttggtattaatacatctctgcagggtttctttttggagcactgtgctgtctttcctagtcagtcagggacttttttaagcttcaaagaacatggtctgatgcaaaggtcttctaccgacttcatggtatttaggaaaaatttttaagtgataataccatgccgagttacctggtcactgtaatactggttctccattaaaatgtagatgctttgtctaattccacttcaagatgatttaattgagcttctataactatcaactatcaaattctagtttcaagtatctcactgtacctatatcatatctgttctcaactttgtttgattctccactcattttcaatcagagttgaagccttctttgcctttcttctttgtcttatttctgccttcatctcccacttctcacccaactctgccactgttcaggagcagttgactaaacttttatccttcctttaacttaatctttttatccttctgtttttagttcttacagtggtaatcacatcagtttggcaatctaagatgtctttatcaagggtcagcccttttctatttggagctgaatcttttctttcatgtagaaatctacatgtatatacaagaaatgtatttttatctgcaggataatattgtttcaaataattttattaagagttaactttttaggtattttcccttttaatgtggttttgaaatgttaattgcatttttacacatgatgcattcagtggacactcttttttcctaattataactcatctctgaatgcattgtgccaatcaagagtaagataggattcagtgcgcaaaatttgcttttgatgcttattaagagtaaacccatgaatttgaatttttatattatgc

SEQ ID NO: 16995 - DNA, 1108 bp, Homo sapiens
tttggacctctgtgattccggaagttccggggcgttccggggcgttctggggcctttggagcgtgggataagcagtaatggcggaggctgcagctcccggaacaacagccacaacatcgggagcaggagcagcagcggcggaggcggcggagacggcggcagcagtctccccgactccgatccccacagtcaccgccccgtccccgagggcgggcggaggggtcggcggcagcgacggcagcgacggtagtggcggcaggggcgacagtggcgcgtatgacggcagcggtgcgtgcggcggcagcgacgcgtgcgatggcagcggcgacagcagcggcgacagctggactaaacaggtcacttgtagatattttaagtatgggatttgtaaggaaggagataactgtcgctactcgcatgacctctctgaccgtctgtgtggtgtagtgtgcaagtattttcagcgagggtgctgtgtttatggagaccgctgcagatgtgaacatagcaagccattgaaacaggaagaagcaactgctacagagctaactacaaagtcatcccttgctgcttcctcaagtctctcatcaatagttggaccacttgttgaaatgaatacaaacgaagctgagtcaagaaattcaaattttgcaactgtagtagcaggttcagaggactgggcgaatgccattgagtttgttcctgggcaaccctactgtggccgtactgtgccttcctgcactgaagcacccctgcagggctcagtgaccaaggaagaatcagaggaagagcaaaccgccgtggaaacaaagaagcagctgtgcccctatgctgcagtgggacagtgccgatatggggagaactgtgtgtatctccacggagatttatgtgacatgtgtgggctgcaggtcctgcatccgatggatgctgcccagagatcacagcatatacaagcgtgcattgaagcccatgagaaagacatggagttctcatttgctgtgcagcgcagcaaggacaaggtgtgtgggatctgcatggaggtggtctatgagaaagccaaccccaacgagcaccgcttcgggatcctctccaactgcaaccacacctt

SEQ ID NO: 16996 - DNA, 1283 bp, Homo sapiens
ggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatatatctcttctccctgcccattaaggaatcagagatcattgacttttgcttgggggcctctctcaaggatgaggttttgaagattatgccagtgcagaagcagatccgtgccggccagcgcaccaggttcaaggcgtttgttgctatcggggactacaatggccacgtcggtctgggtgttaagtgttccaaggaggtggccaccgccatccgtggggccatcatcctggccaagctctccattgtccccgtgcgcagaggctactggaggaacaagatcggcaagccccacaccgtcccttgcaaggtgacaggccgctgcggctctgtgctggtgcgcctcatccctgcacccaggggcactggcatcgtctccgcacctgtgcctaagaagctgcttatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgtcaagacccacaccagagtctccgtgcagcggactcaggctccagctgtggctacaacatagggtttttacacaagaaaaataaagtgaattaagcgtgaaaaaaggaaagaaagaaagaaagaaagaaatatagcctctgagccaggtgtggtggtgcacacttgtaatcccagctactggggagactgaggcaggcggattgcttgagttcaggagtttgaggctgcagtgagttatgactgcattactgcactccagcctgggcaacggaatgagaccccgattcttaaaagaaagaaagaaagaaatggattgtggaaaatcatgagctctcagatgtataaaataatgggttgctggctgggcgcggaggctcacgcctgtaatcccagcactttgagaagccaaggcaggtggatcacctgaggtcaggagttcaagaccagcctggccaacatggtgaaaccccacctctacaaaaaatacaaaaattagcc

SEQ ID NO: 16997 - DNA, 1102 bp, Homo sapiens
tggtgtgccagatcttttcgggcctcccttccccaacttcggtcctagagccacctctgccctcgtcccgctcctgagccgaggggcatggaacaggatttctggccgtagcacgaccctgaaggggccagccggaagaaacagtactgcgcgaacaatctttaccgcattgtcttcccctcccccaccctagctctccgggttcccggcggctcgcgccgaagcccggccccctcagcggctcgcgctgctctcccagccttgacggcccggggtggagggagagaagagggggcagctgagcgggagggggctgggcaggagcagggggagggccgaaaggaggggcctgaaaggggcgggccctgacgggggcggagaacttcgggtcttgggcggctctggggctagtgggagtctgcgccgccgccgccgccgccaccgctgctgccgccgtcgccgctaccgccgccgccactggccgagcggtttttttttttttggtttgccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagc

SEQ ID NO: 16998 - DNA, 1142 bp, Homo sapiens
cctcagcctccctggtagctgggactacaggcgcgtgccatcacgcccggctaattttttgtatttttagtagagacggggtttcaccgtgttagccaggatggcctcgatctcctgacctcgtgatccgcccgtgtcgacctcccagttctcatgttttatctatggaatgctcaagtaggatttactttagatcttttttcttccagagtcttgtttttaatatcttaaggtatgagatttctttgctatcttctcagagatttttctttgacatggtggtaataatgcagcttatggttttgaaatggatgtttgtcatgaatttgctaatcatccagttcttgattagttggtcacacaacaagtgtctttgagcttatttttatttaataagatcaatttctaacgttttagtttcaaaattttagtattaaaaccaatctttgtttaaaacagatgttaagaattagttatttgaaatatctagcagtgtgtgttaatggattagtgttcttctaagtcttttgggcagtgaaggtgaggggggtcttatcctgagattgagttagttgatttttattctgaaagaacgtattactttttatggtagcctacattatgtttcccctcttgtaggtatgttttctgagtcttgaattgtttttcttttttttttcaaaaagggaaaaaaccggattttagttgtcatttggttcttttaggagctgtgtttttgaaagccatcctgtgtattgctaagttcttgtattattttaacatagagtttaacgttaatatttgggaaagagttagtgcattggacctcaaccctgactggacatgagaatcacttggcggggttaaaaaacaaccacaacaaaaaaactgatccctgggttccacccccagagactgattaattggtctgatagggagcctgggcaaaggtatattttaaaagcattgtggatgattcttacatgcatttggagttgaaaaccactgggctattgtttttatcatgttgttagaactttcaagtggataaataagaaaatggatttttttctcaattgttttcagttattagcatgattatcatttgagcattaattgtctgtcagcactgttaagcattt

SEQ ID NO: 16999 - DNA, 1168 bp, Homo sapiens
gccactcttctgcttttggagcctggggcttggggtttatatgggcacgggataggggtgcgtggcaggccaaaagggaacacttgggcgtgaaaacaggaatgcctgttctcatttagggctgcaggtccaggcttgagccctcaccagggaccccaccctcatacctcttgtccttattcttacagtgtaatgaatgcatcagcaaattgaaaacagatagtttttgccgtttcttaatttaattaaaatgacagttaagtactttgatatattgcctttggagtcatttccaggaggctatatttgtttgttttcttggtataatggccagtgtaccaatgatcagttttaagttaaatgtagtattaatgaaacttcagctttttactttctcttcttgtttgtatagcccctttttcctgattagattcactggtgatactaaattcgaacagttccataattcatgttttttatatctaaaaccaattactttttcccctttctatttgtaggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcaggtaggatgttgaagatactagttaaagctacagtggggctggactcagtggttcacatctgtaatcgcagcactttgggaggttgaggcaggcagatcacttgaggtcaagagtttgagaccagcctggtcaacagggtggaaccctgtctctactaaaaatacaaaaattagccgggcgtggtagcatgcacctgtaatcccagctacttgggaggctgagacaagagaattgcttgaacctgggaggccgaggttgcagtgagctgagatggcgccaccgtactccagcctgggtgacagagcgagtctctgtctcaaaaacaaaaacaaaaaacctacattggtgggtctactgttggggtactaaatgatggaacatgttctaaataatttg

SEQ ID NO: 17000 - DNA, 1159 bp, Homo sapiens
ggattagatgaaattattttaaagcacagtagtacagagatggcctgaaacatcataaactttcaattattttatcttttgtaaaaatttacaatgcagttgtcccttagtattcatggaggattggttccaagacctcttaccacttggatagcaaaattggtgtatgctcaagtccctgatataaaatggtttagtatttgaatataactcatgcacatctttctgtatatacttcacatcatctctagattacttatgatgcctaatacagtgtagatgctatataaatcattattatgctatattgtttggggaataatgacaagcaaaaaagtttgtacatattcagcacataggcaattttttctgaatattttcgatccaaggttgttggttgactttgcagatgcagaacccatggatatgtagggctatttacaaaatttttaaatctgcaatgcttgtctatgttggtgtttggattactattttacatatgttatagaaacttaaatgtggaatgtttaatttttaattaagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggtgagttggtgtgtaacacccaagaaagagagcagacaggaaagtaaccccactgcctccttaatagtctttatagcttcgtcactgccaagtgctttataacccatgattcttaatagatttaataaatgaaagggagtgacagtgttagtaaaaatttcacattaatgatgatgaccctagttgggttgtttccgaagtaaaattgtatgttcagtttccctcttggagagtttatgaagtttttttctcattggtctcttggttgctggatgactttcataatttttgggatggcctgaggtaaatcaggtcatgaggacattgagttcctcagagcctgatcctagtgaactcttgactagtttgagctatttaaccatcctagatgtttcctttttttggtcttcatctcagggaacagttcagaatataatttttcacacttatagtacaaacaaccaccctat

SEQ ID NO: 17001 - DNA, 1273 bp, Homo sapiens
agcctcccgagtagctgggactacaggcacatgccagcacacgtggctaatttttgtatttttagtagagacagggtttcaccctgttggccaggctgatctcaaactcctggcctcaagtgatccgctttcctcagcctcccaaagtgttgggattaacaggcgtgagccactgtgctcagcctgacatactgtttagactctagaattgctgcctctcgtgtacaaattccacagagaaaaaatagtaacttgcatcttacctgtggacgtagagcaggaatagatatcttatggtgcctcttgtattttttaagccatagcaaatggcttttgaaagtaccatataaattatgaagtaaacaaattctaatttgtcctttgataatcagtttgatcccaatattaatgattagaaaaatggagagatcgttatttgttaggatacgattaatattggaagatatttctgtttgaaattgcagtgttttgatcttgtaaatcgcctttcccccttgtataacagaggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaaggtgtgttggtttgttattttcaaaattaaataatacaattgttttgttctgacacagaatcttcagtgatctgtatttaaagtgtgacaatgaaataacactttaaatgaaaatacacacaaccaggagcctttttcgtagctttgtcgttctagttctttgttttttctgcatgtataattatccccattgtcttctgtccagcctctttagaagtagtcataatttgggttagtaggaaacagactgtattttttctttgaaatagagtaggagattacttctttgaccaaggactcaattgttgttctgtagggccgtgatcattttaggcattctaagattttgactccaaaatcaagtatatcctctaaatacctaataatacatcataaaattacagaaattgttaatgaaatcaatatagtaaatcttccaaatctcacttaaatatattgtgtacataaatgtaagttttctatattggtgtaaacagactgtacactttaaaaaatttttccctaaacg

SEQ ID NO: 17002 - DNA, 1152 bp, Homo sapiens
agatactagtaccagaccttagtttttaattgacaattgactctcaggctattagttactgtgtttatagggaaattttaatgttttacaactaaacaagaagtagattcaaaattcattaccaagtagcttcttcttaactctcttgaagtctttctgcctcctgaaaattattttaatataaaagactttacagtaattagaaggtattcattcttatatggtgggatatctgaaataggagcatgtcttctaattcctgttcaccacttacattggtacagacagacagaactatgccccagtgatttaatctatacttactacgtatactgcttctgtctcacagatggaattactatgaacaaaatgcaatgttttgtggtcctttgaaagatgatttattttattgaatttactatttctagtatatttcaataaggcttttttttcgtgctttttaccctttaaagtaggaagttaacttttttcattaattgtgttacagggttggctagtggatcttctcaacaaatttggcactttaaatgggttccagattttgcatgatcgttttattaatggatcagcattaaacgttcaaataattgcagcccttattaagtaagttacatttaaaaatcaatggttagtgcaccgtagaattgctggtttttgcttcataaaaattgagtttttcaagtgtggtttcttcaactaataactgggattttttaaaagtaatataaagaatttagtcctaaattgattttaagaaattgcgtatttacaggagttttgtatctttcttatttcagaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttaggtaagatacttacctcttgaaataattgttaatgccgattttagaatcatacttatcactgaatttttcttacagattattg

SEQ ID NO: 17003 - DNA, 1169 bp, Homo sapiens
gcacagtgttacagaaaaacagactgtggaagcatatgacttgattcatattccaattctagcatctgtgagcctgtttacattttgtaatagaataatgtatctcttactaggattgtttggaaaattaaagagataatggataagcaataatagtgcctagcacatgataattgttaataaataaaagtaaaaaatagagagcctttttacccaaggtcaaaacataattctgtggcaaaattgggataaagaatccaaagatcctaaaattggtcctgtactcaccctaccatggtgattgtgtacttaaataatatttttctgagtaaatgctggagtgtagaatcttcttaatttcagtattatttatgggagcatttctgtatgtgcaaaattgttataaaatttcataattttccattaaagcaacacataagtatattttaccagtattatattttgtaaatgtgttttgaatttccttatattatttaataatagtgtgagcaattaagaaaaaattgttttaatttctgctttcaaacacgtttttgaattaacatttaggaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggtaaggaatttaagatgatggctatttagtttttaaaataaagatactaaaaactgaagaaatacagtagctgtcatgaaatggatgcaggcttgtattgtttgactttgagaacgtttaaatgcttgttaccctgccaggaatctttttgaaataaccaataatcttttaaaaataaaaatattcttttatctgtatttgataaaggttgagaatttgtcagtggttttaaataaagatgcaaacagtaaaatcataaggaatgtctattgaaagagagtaaagacatctgtaattggtttcttcatagatttaatagaaagcaaaaacctccagtgtcaggagaattaattcacttgattatttataaagacctgtaataattattccagagaatttataactcttcagaaggattagtaacctttttagtttttgagttggaa

SEQ ID NO: 17004 - DNA, 1216 bp, Homo sapiens
aacagaattttatttggcttatgattctggaggttgggaagtacaagaggcatggtgccagcttaaccgtgagttttgggggggacattcgaaccatagcagtaactttactcataaaacttttcccatattgcttagcagcatccctggtctctactcactaaatgccattagtaccctgcccttccccaagcatgataaccatgttgtattacaataccattttagaggttttaaaaaaatgtattttagagtttttaattgggtgtcttctaaattgaaatagtgtatcatttatttttcttttttggaatttaactctaccctataaaaaaaataccaggctaactatattttcagatctcacttgaatcattctgtgcttagctacgttgcttttgatgaatttgaatatagttaacctggtgacaatttatgaagtggtgactaaatatgtgttgttttcatgtcacttaatttttttctaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggtaagagtgtactgctttgctcactttttgtgacttttccccttcagttaggttggcttagttacaggatagttctgttactctgacattgttagtttttaaatgatcttccggagttgactttttttgttcattagtctgctttccttaggatctgtacatcaaggttttgtgactcatctgaaaagcattttagtctccttgggagaaagtataaacagaacagattatacagtggtggcattatcaagtgtatggttctgaaatgccgtttcgaatagaattcgaatgttaaagctgatagggacttcagagggaagagaaattaggttttctttgctcatagggaagttaagaaaaattaatagaatttcctaaccattaaaacatttagtgcctccacagtgagcaaatcacacagtttccctacattctaatttgtggcatgtgtattttttaacacatggtaaagtgaacattgctgagtaatttctcacatgttaataaaactatttgttaca

SEQ ID NO: 17005 - DNA, 1192 bp, Homo sapiens
ttctctccttgtacgtgtgtttctttattttgattttggcgattatttttaaatgtagttgtcattctatttattttcttagtcaaatatacattttttgtgttcttcactgtactaaaagatggcccatttagagtaagtcagggtcttgttatatattaattctggattttatgatacggtagaatctcttaaaatactggctaaatacctaccctctggcaaacttggaaaatgaaactttctgtcagtgtgcctaatacttaggatctgtagtgtgtacagatatatttcagtccatataatacaaagcttttataacagtgctgggctttttggagttctggtagtaagtgtgaaataaaaacaaacttaaagcttttattatttaaattaaactctttactgtaattacaacatgatgcttgtattgctaatcttaaaagaaaagcttttattttataattctcaaaataatttgaaaataaaattctcctgagtattgatctatttaaaacattgaaatcatttgtttaaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgaggtaagactttttaacatagaaaatttcaatacttaaaatttatgtactttattgaaaagaaacagcatattggctggcaaatgcaaatttttaaattagtggagtgagaagaggctatataagaagtgtttggaacaaaagaattctttattacatctacctcctttttttttattaatgaggaagtaagccacagttaagtgataaatcagaatcaaggtaatattgcctttgggttcttggttcagaattattattatatacatactatatttccagcaagtatgccaagaagtttcatagcatgtctttaaagatggattagaccacaagaacatttaaattgatgaaacatgacaagataaagtttcataatttttaaacatttattttagctaaatttctttttaatagctgtctttatactatcttaggtgtcatattctggttactgaaataatttgtcctattttctggtaatacagttggaactgataacatgaaaaggaaaaataat

SEQ ID NO: 17006 - DNA, 1246 bp, Homo sapiens
caggctggtcacaaactcctgacctcaggtgatccgcccacctcagcctcccaaagtgctggcattacaggcgtgagttactgtgcccagcctaagtcttttatttttaactcaagctactaaacatgcttctttccaaaagtctggtttcaaaaactaaaggttcatggaatgaatcttttattcctaattcagctagctgcatttcaggcacaaagtgggtgttcagtgtgtgcttgttgaattaattaatatctagtggggatttttttttagtaccagataaaagtagagaaataggttattttgaaagaatgaatatctttttatctatagttaaaatataatggtgataaatgtattttataggtaatacagattgcctttccggataaaaattacataaatctaattgccaattttcaatgttttttcaagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtaagtcaaaagtaggaactctgtaaatggtgtctgatgtactttttcatgtacgtaaggaattgtaattttgcatataaattgtgtattttactctgatgtttgtctcaggaatttggtgtagttaggaattgttcatttttattatgtcacctgtcagtgggctttttcttctctcttcctctccctcctcctgccactgatgttccttttgtcttagcttagtatctgtgtattccatagatgtgcactaaacatacaaatctttcattcctcccccgtggatattaatgttccttcccgagttttcattcagtgtcgatctgtttcctcctcttcaatgtttaacactaaaatagaggacagaagagaggacttgtgtttagtatagattatgagtatatgctttattggcactgtttaccttgtgatatttttaaatacctgggggaataaaatactatc

SEQ ID NO: 17007 - DNA, 1176 bp, Homo sapiens
caggcgtgagccactgcgcccagacctatttttcttttctttaaaagaagcttttacttaaaaaaaaaaaaaaaaattatcaaggtatttttttaatcatagggcagttaccttagatcatcaaaatactttccaaggttgattgactattaataaagttggaatatttggtagctaatgcttaattgtattttgggattatcttatttttcccccactgtgtcttttcaccgtaatttaaaattatgttttaatattatgacaaaaggacaaaagctctgcttgctttgaggtgaatgtacataggcacttaccctttttcgatgtttgctttttagggttcattttcttggatatcactacattcctttcagtgaagcaagccagttaatatatagtgtcagggggcaaacaataaagaggttagagggaagagtttataatttttttcttgttattttcagtcagaactacttccttttgaaatgtatttttttccatctccagtggctgagaggagagtatcttgatttgaggtccctgagtagcagatgctttgtattgagagtaactgattaaagagccctgttttttgtttttgtttttgtttattttttttttcttttttaatcattccaggtcttgtcatgtcttaggaagtttgagcctatagcccaactgagtggattgttattccatattagtatggtcttcaagatatcaaaagttaaatatgtatgaacacatgaattacattttcacactgtctctttttttcctccagatagcacaacgatagaaaaattaagagctatttgtttagaccatgccaaacttggagaaagcagccttagtccatctcttgactcacttttctttggtccttcagcctcacaagtgctatatctaacagaggttagtttttggggttttttgttgttgttgttttctttgtttttccttttaaatttattctgtgttctttaaatttgacctttcatatggtaaggtgaatgatttgggtaaaattgtaatgaagtagttttgaaatgaaatattaatttgaaataaataatagtgagatggtcaagagtttcttggcactgacaatagtacaaatagaagttattttttttttaaatcttttaatacagccctctccccctcttctctatt

SEQ ID NO: 17008 - DNA, 1200 bp, Homo sapiens
tatatatatataggaggggagttacaacttgaaggcagtcagaattacctcgctaacaactacgtaatgaaattaatctgtcactgatttaacaacttgattatagcattaagtaaaaactagggtacctttcatacattagtcctcttactgctttttcagtattccttaatttttcttttttttttccaaagaaaaatgtggtaacaatggggaatacaagcagggtctgcccaaggcatgtacataaaagatgtacaatactttactgagtctctagaagggaaccagtctatttagtgtatcattatcccctgcaagttaagctgaggccagatttagagacacgagttgattgctctagaatggggatttgcagacacgtggcactacagtgcacaaggaagagaggaagcccactttgttggcagtgctttttgtgtaagttgccacaggttctataatgtgtatatgcaaggaagtcgttctgcaggagtgggtgatgaatgaagagcaattggttaggtctggttatgtacaaattatttactccaaataaaatggttaacttttttcagatcaaccaagttacccatgatcaagcagtggtgctacaaagtgcccttcagagcattcctaatccatcatccgagtgcatgcttagaaatgtgtcagttcgtcttgctcagcagatatctgatgaggttagttttatcaagacttctgtcacaattttaactttcctaggcccacttattttaatcactgtctcattctatagataatgtccccttaatatcagttttgtctactattaatattagtactttctgtttttaatcaactttatgtataataaacagcatccttttaaagtatacagatggggtgattttttttttttttgagacggagtctcactctgttgcccaggctggagtgctgtggtgctatctcggctcactgcaacctccacctcccaggttcaagtgattattctgcctcagcctccacagtagctgggattacaggtgccacacccacccccccatgcccggctatttttttatttttagtagagatggggtttcatgatgttggccaggctggtctcgaactcctgacctctggtgatctgcctgcctcagcctcccagagtgctgggattacaggcatgagccaccatgcccggcccagatt

SEQ ID NO: 17009 - DNA, 1152 bp, Homo sapiens
aggcggagctcaggccataatgctcatttggccttctggcctggggtttggggacccctggtgtaagagacatctgccacaatagccttaccgtggttactacagaatttccacagagctgttgtgcagaaccacagttgaataaaaattctgtggaaggccaaaaagatgcataaggttattgtagtagagcatttggtatatagaggaacatttccagcctgttccaagaaagaggtgttagaaggtggtatccctcaaactcttagtgtcaatttgaggttatagtcctggacatagagcttaagttcatgtattatgtggtgttggcttgagtgcttgttgtgtgtaggtagggtaatcctgtatccttactattaatttatttcccttttatactccccccacctctcctccccaagagggaacaatgttacaatcattttttaaaatggaaataatgtattaaatgtgaaacattttttatttcagaactgttcgtcaggtggcacaggagcagttctttttaatgtgcaccagatgttgcatgggacaccggcctctacttttcttcattactctactctttactgttttgggggtgagactttttaaaatatgcttatcaatgtgattcattctttaagcaagaaacattcagaaatttgtggttttagcttgcattaaagttaggacagtctatatttaataaatgaagtactactttatttcccgcactgtggtagtcatcttctctagttaactctgggtttttaaaaaagtggattttgaggatggacgtgtaaattgatattattctactctgtttccagagcacagcaagagagagagctaaacactcaggcgactactttactcttttaagacaccttcttaattacgcttacaatagtaatattaatgtacccaatgctgaagttcttctcaataatgaaattgattggcttaaaagaattagggtaagttttagttaatactccatttatatgtcattattagtaaatagaatgttttattgatgatttatattttttgagcattttggttaaatggaaaactccaaagattgataaaagggaccaaagaatgtactctgcatcagtggacgttagtaatctgtgattcacaaaa

SEQ ID NO: 17010 - DNA, 1195 bp, Homo sapiens
tttagtttttctctttggaaaatctgaattgttaatttcatttaatgaggcaaacctctgttttgtaagaatgcatcttgtatatctttaatgagttttttcatacatgtagtaacacaaggaaacaaagtttcatttttgtacattttatttctattcaaaatgggtttaatttgctatacacttgattaaaggagcaaacatttaaaataaaaattttgataagtactatattcagttctttcttaatatttacaaatttatttaacctgcgaaattaggtatgttagtgatagtaaatagtgttttgaaggaagatctttttattagaaaatctgagttttctgagatgtaatgagatcttaaattccaatgagtaattttaaaatgatttacttacaagagaactttttttttctaaaaatatatagcattgctaatatgtaatccctttttcaactttttaggaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactagtaagtatttttaatagaatgtgataattgatcatttcaatgtttcaaagttgttttcctgtttttctttcagaaaatatttccaacttacgtatttctttcagtaactagtttaacatttttagtgagtgaatgaacagttaagaccattataggccgggcacggtggctcaggcctgtaatcccagcactttgggaggccaaggtgggtggatcacctgaggtcaggagtttgagaccagcctgaccatggtgaaaccctgtctctacaaaaaatacaaaaattagctgggcattgtggtgcacacctgtaatcccagctactcaggaggctgagacaggagaattgcttgaacccaggaggtggaggttgcagtgagccgagatcgcgccactgcactccatcctgggtgacagagcaagactccatctcagaaaaaaaagaaaagaaaagaaaagaaaaaagaaaaataagaccattataagcagaccaccttgtatagaa

SEQ ID NO: 17011 - DNA, 1144 bp, Homo sapiens
gttgatatatttagataacatttcattccttgccaaatttgaaggcaaaagtatcaaatattaagaaagtgaataatggctaaaaataaagatgcaagtaaagttagcatgtagacattagaattatactatcttgtacttttgagactgccatagaagcaacatcatatgaaacgggtttgcgggtgattggataagaagctgcacagtggtgcctgttgctgtatattttagattgttggaagatgaagtgcaaactcagaacactgcttcaggttgctgtagggttagtcgaattatgggtggtagaattattgccagggttgctttgtcagcataatagagtttgaaaggacagaatggccgtgttcatgctacaagaatctttccttctctcagcttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgaggtaaatttgagttaccatttctgttttctgtgtttcaagttatgataccagatactattctctcttaagagagtgttatactttcatcaaacgtattaaagtatatttgaaagttagggatgggccgagcacacacctgtggtctcagctactcaggaaactgaggcaggaggattgcttgagcctgggagctggaggctgcagtgagccatgatcatgccactgcactccagcctgggttacagagtgagaccctgtctcagaagaaaaagaaaaagtaagtagggatggacttctcccagccagcatgaactgctacctcttaacatagtatagttctcactacctaccagaatttaaactgcagataatttttagaatggtttgtacatttctaaagcaacagttggctgggcatggtagctcacacctataatctcagcactttgggaagctgaggcaggtggatcacctgaggtcaggagttcaagaccagcctggccaacatagtgaaaccccatgtc

SEQ ID NO: 17012 - DNA, 1148 bp, Homo sapiens
ccatctaggtttataggtacactatgatgttcacatgacaaaatacctaatgatgcatttctcagaatttatccctgtcattaagcaaagaatgactatactgatataggtatattttattgacagatctgagcattttatatacaacagctacacaaaggatatattacccccattcacacataaagaaacttgaagcctagaaagtttaagtagtttttacttgctcaaagttacttggtttataagtggtagagcctgcatttatgtctagttcagtctaaattactatgctaatgctacactatattatctatctttcttacacatggtcagggttatttggttatgataactaatatgtgaaatggtggggataaacactaaataactaaaaatttataaattgaaaagtgctttggaaatgagcataataggaatacaaatcatttgttcaataactgcttggcatttgtctcaacgtattttattatactttagctcattggtgacattttttggtttctagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggtaaactatggatggacagtaatagagatacttcttaaaatgaacatctcaatacactaacattaaacctctaaaagacatgttggaaggcatctttttttaagcactggtaatattcaaactgtccttaattgggtgggtttttttttttttttttaggtccccttaggaagaagtagaaactgccatagtaagtaagggcaacatcctttagtctcttaaccatattattaactttttattaggaaaacatctaataaatacagaagtagaaaaaatagtatgaacccctgtatacttgtcacccaacttcagtagtagtcaacttgtggccagcctcatttaatctatattcttaacctattttttttttctttttttctttttctttttctttttttcttttttttttttgagatggagttttg

SEQ ID NO: 17013 - DNA, 1178 bp, Homo sapiens
catttaaatcagctgataggattatcttgattatgctcattgtcatgtatttgtttatacttaaaaattcagataagtcttaatatcatttaaaagtttgcttggggtttttttttttttcctgtggattttaatagaacatctggtaactttgtcttgtttattttaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccggtgagtatcaagagagtttagcttcttagtaataaagaataatttatagtaggcgtcaacatgtttaagttcataaaattaatgttttcactttaaatgagtctaatttgctgggtgtggtggttcacgcctgtaatcccagcactttgggaggccgaggtaggtggatcacctgaggtcaagagttcaataccagcctgaccaacatggtgaaaccccatctctactaaaaatataaaaattagccaggcatgg

SEQ ID NO: 17014 - DNA, 1418 bp, Homo sapiens
atatctatctgatcattataatgcataatgttactttcttcgttgtgcttaggtaacttgatttaaaatgttatttctctaaaataaaacatttggccagacatagtggctcatgcctgtaatcctagcattttgggaggccgaggtgggtgggtcacttgaggtcaagagttcaagaccagcctggcaaacatggcaaaaccccgtctctacaaaaatacaaaaaaattagccaggcgtggtgacgtgcacctgtagtcccagctactcggaaggctgaggcaggagaatcacttgaacctgggaggtggcggttgcagtgagctgagatcgccccattgcactccagcctgggcgacagagcgagactccatcttaaaaaaaataaaaaaaaattataggctattttctatcgtgaaagttgtgtattattattgtgaagaagcttattagttttttattggtgacaaatctgtattctaggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggtaaaaggaaaataacatttgtatgtttataatttgatttgttattcctttcattaagttactcaccatgtcttacttgtttttaggttgcatattcctatacctatgaactgcggccctatttggatctgcttttgcaaatcttactgattgaggactcctggcaaactcacaggtggatactctttttgtgactggaaacaattaggcttgcccaggtgttagagttaactgaaattgacagtcaccacattttttttaacctattggagttctagtgaatgttttatcttaaacctaggacaagggtaaataacaggttctccccttttcctcagaattttatttccttttttattcttttttctcactgcctaagtttcatacttaataagcctgtttctttagaatgacttttttaattaaggaggagctagcttgggcatttggtaaatatttgaatttcattaatgatgcccgaggattattttatgattatattacatttgttttagaattagtcacttgaagcaacttagtcattagtcacatgaagtataatagtatatgtaaaaagtcttcaggtaagtacggtttccatttttcatggtacttatattctgtaaagtcaccacagacactgagttagcaaatactgaaccattactcctaggaggaaatacagaattaggtttctataagcctctgtttaca

SEQ ID NO: 17015 - DNA, 1246 bp, Homo sapiens
aataagttagtaagagcacagactctggagtcacactgctccgcagctatatgacctcggcaagctgtgtaactctgtgccaattttctcacctgttaaaagttttaataataaggccaggcgcagtggctcatgcctgtaatcccagcactttgggaggccgaggcaggcggatcacgaggtcaggagattgagaccatcctggctaacacggtgaaaccccgtctctactaaaaatacaaaaaattagctgggcgtggtggcacgtgcctgtagttgggctgaggcaggagagaggcgtgaacctgggaggcaggacttgaagtaagccgagatggcgccactgcactccagcccaggccgtctcaaaaaaaataaataaataaaaaataaaggtttaataatagtacctattgtctaatgttagattaaatgactaaaagacattattgagtggcacatagtaggcactcagtatatattagctattagattttagatgtttttattttatatctggttctctttcagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcaggtgaggatttttttcttataattttgtagaaatcttaatcagaattaaggattctgttttaaaagaagagaatcatgagaacttggggttgtcattttaagttaactttgaagtattccaaatcctcttatctatatggttttattttcttttgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagtaattctttattttataggccagtgtttatgtattaatgatattattaaaagattatgttgaagttttgggttttgaaaaatgtttattcggctgggcatggtggctcacgcctgtaatcccaacactttgggaggccg

SEQ ID NO: 17016 - DNA, 1297 bp, Homo sapiens
gcagatttagtggagggtttggtgccagagactaccgacaaagtagcggtgccagcagttccagcttcagcagcagccgcgcaagcagcagccgcagtggcggaggtggccacggtagcagcagaggatttggtggaggtagtgttaatctgtaacttcatagctttgggaagggtttttttccttttagtcatctttttcaaagcctaattaaacaatttaagttcagcactatagaaacttgatggcaaattacgtaagggaaggattgtatttaatgatggataacttcattaatttctctctctttttaaatctctcattaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgcca

SEQ ID NO: 17017 - DNA, 1866 bp, Homo sapiens
tcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtctcctttgttgttgtcaattgtggtttattttcagaggtgtaaataaagtgctcttgcctgaaaaattgtaaaatgttattttttgcttgtcatccagtgctattttttgagatgcctcttggatacagaatgactcataccataagtatttgcaatgaaagatgaagatagtattagtttgaaatacagtgaaacaggatttttgtaatagacggaaatctaaaaggcccttactgataatacagcatgtattagaaattggcttatactttgaacaatttgacatgggtgggagtctctttgttctttgaagtatctattatgaaggatggttgaacagtggaagaatgagcaggataaaagtcaagtgtgtcagtagtccaacaagtgatggtaagtatatacttagggaaggaatcaagactatttgggccaggtgtgatgattacatagtcctatagtgctagtttacttggaagctgagggg

SEQ ID NO: 17018 - DNA, 2789 bp, Homo sapiens
cctctgagaagcacacaggcaggcatcattcttgccatcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatctcttgtcaggtgagatgatttaaaatctttgctcagagaggaaaacaaatggttgacctacttcttgctatttgcattcagaaggcatcgtcccagcccatcctattggtggcagaatatctaaagatgtcgcaaagtcccccactgcagtagaaatgcaggaggtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgc

SEQ ID NO: 17019 - DNA, 1066 bp, Homo sapiens
ttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctata

SEQ ID NO: 17020 - DNA, 1114 bp, Homo sapiens
gcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgta

SEQ ID NO: 17021 - DNA, 1523 bp, Homo sapiens
cctccgatttaattatagatgcaactatcccaggggtctccatgcatggatcttgcagtgttttgttcctccttgtcagcatgagttttttgctcatgatctgtgttccttcatctaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcaaacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactca

SEQ ID NO: 17022 - DNA, 1186 bp, Homo sapiens
caaggttcatccctgttgtagcataattaagagtatttttgtttaaactttgtttcaggcaacagaatttatcaagcagaacattgtgatatccagtggatttgtgggaggctttttgctcggacttgcatcttaaggacatgaatattctcccataacggattcaactatgagaagagaagtggcagcaataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttgcatctgtttagaaactagcctataaaatatcaccattggatgtagatatggagagaaaagaaatatgttgggtttattgcttagcgaaatattctctttttatttaaataaaatgttcttcattgtgttttatggtatgtgtccataatttaaaattcatgttatagtttcagtattaaggctgactttttttttttaagatatgtttgcaataagttaaaaaactgtaatacccttttgtggaaagctttagaaatgatataattattaaagatattaaacagactctgctgatgtaatatgataccaatttttatgttgttttttttcctggagttattactttgttataagtgtaataattgtacatttcttttttgttttttttttttttttgagacagagtcttgctctgtcacccaggcttggagtgcagtggcatgatcttggctcactgcatcctccgcctcccaggttcaagcgattcttgtgcctcagcctcctgagtagctgggagtacaggcacgtaccaccacacttggctaatttttgtatttttagtagagacgaggtttcgccatgttggccaggctggtctcgaacccttgacctcaggtgatccgcccgccttggccacccaaagtgctgggattacaggcatgaaccaccatgcccagccataactgtacatttcaaaaaaggctcttctgaggaaatactataacatgtctaaagctcttttttcttttttgatgtctgtagtttaaaaaatatcttcttatatgtaagcttcta

SEQ ID NO: 17023 - DNA, 1148 bp, Homo sapiens
ctactgggcaaggtaaggcagctgcgagtcggagcgcggacaccgtctccctggccggcgccgcgctcgccccgggccccgcggccgggtctgtgctcattgtggccacggacgatggtcgaggggcttccggaaactatttcctgcctctgctctccccccacccccgggtaccctgcttgctcccttgcgaaatcgctcttttcctcttgtagctggaggaacagagacgggatcgctttggggccgggctcaactgggtcgacacaactgcctgctattttacagctttttgagggtaggccgatgatcttcgaggtgcctgtttagggtcaagggatcgtgagtgtgttcagattttcccaaatttcggacttaacttgcctctacgggtttaaaaaaattcttttccttcaagcaggctgttcgtgatgcctactgctaaccaaatgttttaggctttcttgtgtccccgctcccagaagggggaagtttcacggagtttaggtcggtgaagagtttgcattgggctgttgacatgtatctcgattgcagtgtgtgttacctgaagttaggtgacttgtttactttttgggtctttttggcatagaaataccgtagttatttgtaaacgtgttctcttcctggagcctcatttcctgtgtgtctgacaggggaggctggggaggattcggggtgtagtctttttttatttgtgtggaaagttgttggcactgtcatttagttaagtaatggctgctcctatcggcccaagatggcgggacagggtgggaggagaaagtgaaggggggggttagggggagggtgtagaggtaaacatggaaataaatagtagccgtgaataagcctttccttcggagtgtgtagctcagtggtgtttaaaaaaaattacccaagattatttgcatatagaattcttatacctttcataagcttggaagcagcatgcataagcctggtaaatgcttatcaacctgtagcacatttagttatccatctgtaagctattgaacaaaggctggagtctcaatctgtatgcatcagtttatatttcctgaccaaaatctgattgcaatggtatttgaatactttcttcgtaattgggaccgtgaaagttggagtgtgtg

SEQ ID NO: 17024 - DNA, 1197 bp, Homo sapiens
ggtttgtttacattatttagtactgaggcaaggtttttagggcttatttagtttacaggatctggcatatatgtaacagaatgaaattttgagatgtcccctcttttgtgattgagagaaggacctataagttcggggtcgttttctataattttcagctgcttccttttgtcattactaatgggattttttttttttgaaaccgacttttgctttttcaaggaagtttattttaaaatgaacaaatacaatttcttgtttttaaagtatgtatttctcaacttagagaaattaagcatttgggtaaaatcacacattccctaattatacatcttcatattcatctggggattcatagagaatcccctatagattctcttccctatagattacacaaccagcatttacttttcctttgtttttttgacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggtaataggaggactagcttccttgttggcttttcacataaatgtttttactgggttttatacactttgagagaagaagagagaagtgtttggggaactggttttataagaattttgtggcactacaatgttactacattgtgattcattatgtacatacatgagtatatctttgttccctttgtacagtctctaccgacatagataacttagcaaatttacaaaggaagaaaatagatcatataaatcacccaaaatgcaccattaatttacagtggcatcataagcacatttatgtaatattacttagttcatttctgcataaactgcctacttaagatcaggcactaaactaggtgttaggtatttgct

SEQ ID NO: 17025 - DNA, 1271 bp, Homo sapiens
gtaggataatggtcttagattcttaggaagattggctgaatgggagatagtaaggtaggctgtacttttatgttgcatagcaggctgttgaactttttgagagttatttcccctaacttcacaagcagactatatgtttgtagccatgagctattaacaatttgtatatcaaaataacctaccttacttttattttcaggctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgagg

SEQ ID NO: 17026 - DNA, 1202 bp, Homo sapiens
tatgagttgaatttttcatagcgcttttattaaaacaatcatttaaaaatatatttttgaccctggtactctacaaagcttagtacattttttacttttataaattccaaataggctaaaagcctactgacaatattgacagtagcaatgatgatgtaggtgtcacttgggttaagtcatgggaaaactcaaaccatagtgtcacagaggctaccctttagctttgcatgcccagaacacaatttaatagcaaagagaggggatctgtcttctgggaggtgtgtatgttgactaagatcataggttttatattattattgagagaaacaatttgtcctgttcattttgttactgtgtttcaaagtcattgagattaagaatttatatttcagcactaagaactgtgcctggcagccaatagtcctttagttgatacttgttgaataatgttaataatactcaaggtctgtgttttgttcctgcaggttgatccaaaagactacatgttcagtggactgaaggatgaaacagtaggtcgcttacctgggacggtagcaggacaacagtttctcattcaagactgtgagaactgtaacatctatatttttgatcactctgctacagttaccattgatgactgtactaactgcataatttttctgggacccgtgaaaggcagcgtgtttttccggaattgcagagattgcaagtgcacattagcctgccaacaatttcgtgtgcgagattgtagaaagctggaagtctttttgtgttgtgccactcaacccatcattgagtcttcctcaaatatcaaatttggatgttttcaatggtactatcctgaattagctttccagttcaaagatgcagggctaagtatcttcaacaatacatggagtaacattcatgactttacacctgtgtcaggagaactcaactggagccttcttccagaagatgctgtggttcaggactatgttcctatacctactaccgaagagctcaaagctgttcgtgtttccacagaagccaatagaagcattgttccaatatcccggggtcagagacagaagagcagcgatgaatcatgcttagtggtattatttgctggtgattacactattgcaaatgccagaaaactaattgatgaggtaaggagaaagagaagagaaatagtcatacacctagatttaaaaatgtac

SEQ ID NO: 17027 - DNA, 1227 bp, Homo sapiens
ctactaacagatgttggtatagctatttaaagactacttcgtaagtagtatgattatttgaataaattacacattgtttagttttttaatacaactgctatatgactcttctgcttcctgataagaaaaggtatatgcaatgctaaaactgtagaagcccaatcaccagcagtttttaaaaaggtgataacttttattagctcttgtgggctatcaagagaattggaacaaaaccttgtgacttttaggtaagaaataggcatgatgataagctatgcagattattaaaaagcttgatacatttgatttttcattagatatgccattcatatcaagtaatgttcaagtatgataaaattattttggttgctttaaagcactgtttcccaaatctacctgatcataataatttaccaggaagcagaggagagctacttgtttaaaaatccacattcttggacccaatcctcagatgcacggattcagtcttcaggggaaactctgttttaaggggtatgttgtaatctaaagtaattggttcaggaggtgtcaataggttgaacttgtgagaaggcactgaatctgccatccacatcacatatagcagctattatgaaatcagctttcataggcctatttttaaaaggaatctgaaatttaattctattttgataaaactaagactgaaaataaccacttgtaaacattcctatgattgttactaaaatgtattttcatgtttaaaatgtttttggatatttttgggttaataactactacattgaattgcatgttaaggtgcagaaataatacattaaaagattttcactttaaattaattagtaatattgagcgctcaccctgtgcgtggccttgtgctaaccattagcactgcatcatttcaattcttttataagggcattcaatactacaaaatcaacatgatttcataaggtgcaaataaaagttggtgacagatttaatataattttgatcacaatttacaaatgatctttgcaaatagtggtcagacggcattagtttttcccttagttaagctaaattaaagggactccatcctgttatgattatattattattattattattattatttttgaggtggagtttcactcttgttgcccaagctggagtgcaatggcgcgatctcggctcaccacaacatccgcctcctgggttcaagcgattctcctgcctcagcctcct

SEQ ID NO: 17028 - DNA, 2995 bp, Homo sapiens
ttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccagggtatttgctcagtaaatattttggggcagctttccggttatataacacattgacaagtatatgtattaagagtccttgcattgttaactgatttgcaagagaccatgattatcagacactaaaactacttatcttttgaagctacagcatgtgactccccagagctcctgtctgtaggaagtttctaattccctggtatctataaacccttttcaggggagagaccggagaccccatcttagatactgtcaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcccctttttaccaatactttttcattaaattatgaaaactgctacctactgtcagtgtgttttttattttggcatattggttacacatgttccttttatatttaaaaaattatattcactgaacaaaacagatagtgtggggagagggaggaggaagaggaggaattgaatgtttagaagcacacattcaacattcgagtcaataccggggacccaggagaactctggatacttgaactttacccagaaatcatgattttatcagactgttaagataaaggccttaggatcatcataaaacatcaccagagagatagatcctatctaaagtgacaagattgaaaaggcttcagtcaggcatctctatttggagtcttgtgagtatgttgatgtcatggggttatgtggtgtcaaggggggcttttaggcattataaacattttcatgattgaaaaatgtacttgccaaaggtcattgggtaaatcagtagtgaagataggtaaaaggtgaagttggttctctctctctctctctctctttctctctctctc

SEQ ID NO: 17029 - DNA, 1454 bp, Homo sapiens
tagataatataacatgagaatgtatgatatacagagaatggggaaagtatgctacttaggtaaacatagactagaaagagacagaaggaagagaggatgtgaagacaaagttaagcaagataagtggatagagaatgacttgggtgtagggggctatttcattagcttgagctataagaaattgccagtattcaaccatttgtgacctataaaaatagcagtttcctatgcttcaactttgaaagacaaggtaactagggagtgcctcctgaaggaagtggtgatgaatctaaaaccttgaatgaggagacagatccagccatgactagagctggaagaaaggctttccaggcagagagagcagcaagtgcagtggccctgcagtgggaaggagcttgacatatcccaagaatggaaacagaggaatttagtgagaggggcacatggagaccaagttatgcagggccagaataaggctttgtggagcagcaggaagccctcattgacctctatttctccacagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggtaagaggcagaggcagggatggaggttgaaggggattctgccaggagttttgttcctgcaccattgggaatggggagctgagatgagggattggtatcagttgaggctccctcacgtctacccctgctatttgcactaccaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctgactcgctagtgttgattgtgttgtgaaggggatatgggatgggggtgtcaaaagctttaaaagggctgctgcaaccttccctgggtgttctggctgtatattgctgtgtagcaaacacctaaaaacttagtggcttaaaaccacaattcagtcttctctttcatggccctgtgggttgactgggctcagtaaggtggctcttctaggggtctcaggtagttgtagttagatggtggctgggactggagtcatctgaaggctcaactgggctgggtatctaagatggcttcttcactcacatgtctggcacttcagtcctcttccatatggcctctctccagcagaacagccttgactttttttttttttttttttttgagatggagccttgctctgtcaccca

SEQ ID NO: 17030 - DNA, 1245 bp, Homo sapiens
ccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaaggtgagaggcgggggggggggggggggtagtggggacggaaccccgaaggggtcagtccgggatcggcagatggggcgctgtagaggacgttcttaggcagtagaggactgcgcggccggcgaaagcctagaagacttgggaattttgcctaccttgtgttcctcctttgtctctcggtatcttcgttccagggccagaggcaggattggttttattttgcagacagaaatcacacctcaagtggacagcgctcaaaacacgttagaagcagtatagtacaacgataatactaaacaccgatatggcacttgctcgttgccgtctgcattcttttttttttttttatagggacgagatctcgctatgttgcccaggctggtctcgaactcctggctcaagcgatcctctcgcctcggcctcccaaggtgctgggattacaggcatgagccaccgctccgggccccgtctgtgttctaaacacttgacatgcattagctcatcttatactcgaaacaaaccccatttcgaggtgggctctattattatactcatcctacagatgaggaaactgaggcacagagatgttaagt

SEQ ID NO: 17031 - DNA, 1146 bp, Homo sapiens
agtttagtcacttgcaggacgctacacgatggatggaagccaatcaggttgctttgccgcacttgaacccccccccaaacaaatactactttgtaatcgagcgctccccatcgcctgattcttatggacacagttccctgccctgtggccctgtgtcccatccccccgccccctctctccccttcctgaccctcactatctcctcttcccatctctcgctaccccactgggcttctcatccagagcccacactcaccactggccccttcctaccaccaggcactagtgctgccccttcacctctcccagctgagcgttcagagaaagagctgccagggtgggttctttcacctagcttcccactcccccggggctggtggggggggcacccctctctggggttagccagagccaggacctcattccaccctcaggaccactggaagtcctgccagtgaggagcttagctattggcacagtcactagcaagactcattttgtcagccccatccctgcatgtgaatttggccctttgattttcatgcaaggggacagcactgctctgttgatctcaagttcccgtcgagtatgatagttttatcgacaccctggcctcacttcgccgcccctacccttcctatcacatctccacactcgcaggaggcaccacctcaggcagctctgtcttctcggcaaggacctgtgcacagtcagccctggggggagcctgtcccccaagcctggcacgggatcccaactcagcagctttgggacctccgagacccaaagatctgcctggtcacccacccctgcccagatccctggtgtagggcactggagagcagtttcaggggaggaaggggcagaggtggtagaatgggggatcccggcagaggcagccctggggccgtctcctcggggttggtaggctagtgccatgggcccaggacccagccatccatgggaagacggcctcatggcagaaacttccatctgttcgaaatggctctttctttttccccttctccagcactagcgcacctgcgctctctttctctttttctcccctctccctccccctccctgtctcccctcaccccccaagtgtagcctgtgtagtcctggccctgggtgtggcctggcagt

SEQ ID NO: 17032 - DNA, 1150 bp, Homo sapiens
cctctactatgaccccaactcccaggtaatagggcagcccagggagggatgggatcgggtcaggtcgcgtcaggaacagctagccctgcaggttcccttcacaaggtcttccctcacatcccctcttccctcctcctccctcagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacaggtgaacaccagggtccagcagtcactggctggctgtgtggtgtcttccagcaacggcactctgtcagctcttgccctctcctgccaagggagatggcgggcaggtgtggatgtgggcagtgactgcttagcagaccatgctcttgccccagctctgctctttgctgaatggccttgagccagagcagtctcctcagtgtgtggcagggttgcccaactccaggaggtggcttgtgccatccgagtgagccctgtcaggtgtcttctgtcccatggtggggaccctcacattctgctggtgaatatacatgtatgccagagaaattctcacaggccataagggggtgggcaggaaaaaagccctgcaatgttttgtgggagtgggcagatggagggcacctcagtgtctctctgtggagaaagggtgtgacactgtgagcgtagcgtttacaagcaagcactaagtgttaccttagcaacctgatgaattctaaaaatggtgctgtgctggggggaacatggaaatatagaatgtggcattgtgtcatgcatataaagttatacacaaataaacattcctatgcatttttaaatgataaaatggaaatgcacaacaaatgtgacagcgtgggtgtatgtcaggggaagaggagtgtcttcatccatttgctgctccataacaataccacagactgggtaatttataaggaaaagagattgatttggctcacagttctgtaggcagggaagcccagtggtgttggcatctggtgagggccttcttgccgcatcataacatggcaaagggcaagagagcatgcatgagagcaagagaaaattgg

SEQ ID NO: 17033 - DNA, 2265 bp, Homo sapiens
aaaagaaaacttcaaaaatagcttccagcctatcagctccctgcgagatgacgagaggcgggagtcagccactgcagatgctggctatgccatcctcgagaagaaggtgtgttggggccacccccctgcaccctgccccacaatcttgtccttcctttgggccctctgtggagtccctgaatttctgtgtccctccaccccagggagcactagccgagagacagcacaccagcatggatctcccgaaattggccagtgacgaccgcccagtgagtgcccaaggcagagaggggcgggggctctgatctggccaggcctgaccgcccaccctcaccctctacagagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaaggtaacagcggatggttggcagggcatgctggggcctggcccactgaggctcatcctcttcacttctcatcctgtccctcttgcagcaaaaccttgagattcaccggcgagcccacttgtcagaaaacgagctagaagcactagagaagaatgacatggaggtgaggtgtgacctgaccctgggctccctcccctgtgtcccttccaagtccccatcacctcaggcagctggagttcaatttctcacgtgttaaccccgtgagccttcttccccattttcctatcctggctgcttgtgcctgtgatggcctgaccctcaggacctgagcctcattagccagatggcatgccctgtgggaccccactccccatgcctgtgttgcctgagaaaagagaccagctccccaacattcacatacacatacaaactttcagcaaatgaagtaccgggaccgtgcagctgaacgcagagaaaagtatggcatccccgagccgccagagcccaagaggaggaagtacggcggcatatccacagcctctgtgtgagtggctgggccaggtgagggggtctggagcccggggccggggccggcaggccgaccactcatgctgtgcaccgcccctgcagagacttcgagcagcctactcgggacgggctgggcagtgacaacattggcagtcggatgctgcaggccatgggctggaaagagggcagcggcctgggccgcaagaagcagggcattgtaacgcctatcgaggtgagtctcaggcagtcctgtcccatcccccagcacccctcacagcatcccccaccagcctgacagagcctgcctccctcacacaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgcatgttggcctctcctctttctcgtgctctagcacagttgtatagcctatacagacacggggacccaagcagatggacaggggaccttatcaggccaaggtggatggcagtggtggcattcagtgtctggaacataatggctactagaacatggggttctgacctgtaccccgacccataatatcctggttatggcccctctcccttgttggttccagcaggttatgttgtaccaggaaatctagcaccaccaggcatgaagcgccccctgatcagagctaggactgggaacccccatcccctgtccttgctgccccctggctttacttagcctgcagtcccaaggctaaactgcattttgccatccctagatctggagacaatgccctcaggcatctccaagtagaatacaagaggtactcaggttccagttggcccagagccctcaacaggctgatgacagaggggtggaggtggagcttggcctgcaaatccaaggccaggtcccagggatgccctttgagaaccattcaggcctaccttctctgttgt

SEQ ID NO: 17034 - DNA, 1100 bp, Homo sapiens
acttgttcttttcctctattcctagggaatggccaagaacggcagtgaagcagacatagacgagggcctttactcccggcagctgtaagtggggccaaggccgggctgaggggtgtggaatgggacattgagaggataaggttgggtggggcaggccctgacctagagtaccccctaacctggcaggtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccaggtacctcttcctagcacccttccccctttcccccttcccgaggcaccactgttcccggtgccacagccatttcatctttttccctactgcacacccttacagttctacctgcgggaggaggacatcggtaaaaaccgggccgaggtatcacagccccgcctcgctgagctcaacagctatgtgcctgtcactgcctacactggacccctcgttgaggacttccttagtggtttccaggtatcttgggggtactacccagccttctgcccagttttctcagagcccatctctggtttattcagtagtgttcaatattgatttaatgggtcggcctgaatgtcaggttttgtgctgggggactagagtatgcaggcagcagttagcccctggccctgccttttcttttcttctttttttttttttgagacggagtcttgctctgtcgcccaagctagagtgcagtggcgcgatctcggctcactgcaagctacacctcctgggttcacgccattctcctgcctcagcctcccgagtagctgggactacaggcgcctgccaccacgcccggctaatttttttttgtatttttagtagagacggggtttcactgtgttagccagggtggtctcgatctcctgaccttgtgatccgcccgcctccgcctcccaaagtgctgggattacaggtgtgagccaccgcacccggcctggccccgccttttcaagtggggaagatgtgtacagac

SEQ ID NO: 17035 - DNA, 1427 bp, Homo sapiens
atatgttcctgggttctggccggggagttgaagggagaagacatggcccttggttcagagttgggaagacacatcctggtgtttgagatgaactacagacaatcctgtggggtccaataagagctggtgggcatgggggagaggtactgtgtttgagctattcctgggagaatgtgtccctggtatctgagctgagtggggaaaaagtctctggtgtttgaacagggcagatcagcggatctacttgtgtgtgagctgatttggatgggaagcagagaaggtcttcccgtgtagacttggagccagggacacagggtctcacggggtctgagctgagtctggggcacaggagagatggtttctgatgtccaagtggagcctggagctgagggaagacagcttctgatgtctgagctgagtcggggcaggaggttccttatcttgcaggggttgtggattttagggagaatgggtagactgacagctctcttcctgccctctgtaggtccttatacctttagcatctgtgacacctccaacttctccgactacatccgtggaggcatcgtcagtcaggtcaaagtacctaagaagattagctttgtgagtgtgtcgatgggatcagtgggctgtggggggtggttctaggcattccctagttctccattcctctcttctggttctgatgacctctccccccgccacagaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggtgggtgagtgggcgagccagccagcgcagacatgcctggcactgcaggctcaccatgcctctctgcgtgtccacactccctgccctcactgtggcctgacatatcctctcttggttctttctggcccaccaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggtcagcacgggtggggagaggcaggattggggtgggccaggttcctccatgactctgtcacttgctctctgtctgtgtcaggcccctgttaaccactgaccaccccctctctcccttcccctctccaggcctgctccgggaagttcatgcccatcatgcagtggctatactttgatgcccttgagtgtctccctgaggacaaagaggtcctcacagaggacaagtgcctccaggtatgtgggtgggacctgtggggagggcat

SEQ ID NO: 17036 - DNA, 1099 bp, Homo sapiens
cttagcgccagaaccgttatgacgggcaagtggctgtgtttggctcagacctgcaagagaagctgggcaagcagaagtatttcctggtaagtggtccccttggatgtctgctcccctcatcttggcctctggccatcacccctggggcttccttcggcatctcaatgcaaccggtggcgcattctctttgccattctccttatcttgaagggaagcccagtgcatccctcgtttccccttctggtgcctccttcctcacatgactgcgtgtcatttcttagagtcctgcaacctgaagatgtggtgttagcccctctccccgtctctcaggggagtgaggggtgatgggtagcttcacactaacctgcatcaccctgaccagcctctgcctgtcttcttggttgcttcttaggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacggtgagtagggtaggaggttggggctttgtcgtctcactttcctcctttttctttttttttttttttttgagacggagtttcgctcttgttgcccaggctgtagtgcagtggcgtgatctctggcccaccacaacctctgcctcctgggttcaagcgattctcctgcctcagcctcctgagtagctgggactacaggcatgcgccaccacgcccggctgattttgcattttaagtagagacagggtttctccatgttggtcaggctggtctcgaattcccgacctcaggtgatctgcctgcttcagcctcccaaagtgttggtattacaggcgtgagccaccacacctcacccctcctttttcttgttcccattctttctgtcagagatctttctgcctctgccagaagcccttctttttggcctttctttccctcagcttctgttttttttttttttttttttttttttttgccttaacctctttttagtgctggttgggacagtgtgtctggggtcctcaaaactactct

SEQ ID NO: 17037 - DNA, 1178 bp, Homo sapiens
ccacttccagagtagctgtgcgccttgtacttgctttattcactgatggtccttctaataatgcctgcggaaacccattttgtcaactgtggccacatgtaatctgtttgctctgtctgcagtgggctcgggatgagtttgaaggcctcttcaagcagccagcagaaaatgtcaaccagtacctcacgtgagtaactcgagtgccctctcgccctgtccctgtccaccagccaaggcatcccggctgctttcctcatgacagtaacacttggcaccaggcacacttttcacatgaatgagtggctgttggggcctcatgttgtttggggtcgggactagttttccatggagaaagtaagattgctctggagcccactcttgaggctgacatgtaatcctatcctctgtcctcttcgattcctgatagagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccaggtaatgcccagttgttgggtccatttggcagaatgtgtttccctgaaatgggagcctgcagtgtgggtcctcccactgtggagtccagctgtggcaggtgccctgaggcatggggatctgagaagagtgattgatcctgacctgctttttcctcaccctagttcctttgagcaaagaggcttggttgctattgcccttgactgtggtgtgggctgcgtcatacctgattcccagtcagggctgtagggattatgggggagaaattctggagttaagagcacaggaatcaatatgggttcaaatccaaactctacttgaacttaggcaaatcacgtaacttctctctgtacctcagtttcctcgtctgtgaagtagaaataatagtgatctatctcatggggggtttggggaggattaactggtatttattaaaatgaagttagtacaatgcctggtaatccatgagagtttgttaaatgatgggctgtttagcacaaaatggctacccagtgattggtaattgttctctcagccagatctctggttcaacctgtg

SEQ ID NO: 17038 - DNA, 1435 bp, Homo sapiens
ttctctcccaggatgtctctcctttccaaatcctttttgtacctgaataccttttgccccaccctgggctctcatttccatctcagaccttagcctgggatctaaagggctgacagtgtccctttcttcatgcagatgacagtcgtctagaggagctcaaagccactctgcccagcccagacaagctccctggattcaagatgtaccccattgactttgagaaggtatggggtggggctcaggacagggaaggaggatgggcaaagcatagacaggctggagaaaacaggagtatctggagccagccccgggcctttgtggggatcagattgtgggcctgccatatggctctgaatgagtaggtgttcccagccatccctttgtgatctgggagagtccagcaggcaattgcagtggaggatacacatcttctttatctgatcctctccccactgccttcacaccctccccactcataacaggatgatgacagcaactttcatatggatttcatcgtggctgcatccaacctccgggcagaaaactatgacattccttctgcagaccggcacaaggtgaggggaatctaaatctgatgttccaccctcctccaggtttgagttacccacacttagcccctctgtagaccctgaggctcttgtacttaactaccaccttcttttgtcccttctgtctctcagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccaggtgggggcctgcatccgaagcagggtttgggtggggtgtatctgtgtagatctggttctgattcacgtcataccctgtcaccaggtgagggtttctgtctgtgtacctaccctttttgtgtatcctttttcacttattcattaatcacattatttgagtacgtgcgaaaagatgggatatttgaattgtgccctgggagattattagtaactacacaataatggcagccaaaatttattggacgcttcctacacttaagtgctttgcttgcttcattaatgaattcactcaaatatttattgagcaccttttgtgtgcagggactcttctaagttatgttcctcaagtagattatataaataacctattaaatgattttggaatcaaaaaaggataaaaagaggccgggcgtggtggcttacgcctgtaatcccagcactttgggaggccgaggcacgtggttcacctgaagtcaggagtttgagaccagcctggccaacatgatgaaaccctgtctctactaaaaatacaaaaaattagcc

SEQ ID NO: 17039 - DNA, 1588 bp, Homo sapiens
gcactcccgcctgggtgacagagcgagactgcatctcaaaaaaaaaaaaagataaagaggacttgagaataccagggggcgaggggatgtatttgagattttgtgtaggatggtcagaaaaggccttgctgaaaagatgacatttgagatcagacttggaggatgtaaggggacaaactgtgcaggcttggtggcgagtggggacacattccaggcagagggaccagttcttgaaagggtaccaagataggggtgtgcctggcaagttggaggaattcaaagtccccagagtgagtgtgagattgaggagggtaggagatgagaagaaaacagaatttcattgcttagggtgagataggaaccacaagaggatttcgaacaaaagagggttgtgatctgactaaacacgtctgcatgggggtaggggggatggagacagatgggggctggaccctctgggatggtctccatcttacactcccctctttgtcttgcagtactataaccaagagtggacattgtgggatcgctttgaggtacaagggctgcagcctaatggtgaggagatgaccctcaaacagttcctcgactattttaaggtaaggcccctcccttactctgtcaccccacctcagggggcgaggtgtacacggtgacttgctggcctgtccacctccatgaccctgctgttccccctccctctccagacagagcacaaattagagatcaccatgctgtcccagggcgtgtccatgctctattccttcttcatgccagctgccaagctcaaggaacggttggatcagccgtgagttggacactggccaggctaggggaggccctgtatgggttggggagcctcatcatccagctgtcccactccagttcactgcccctacctacctgcccatcctctcttgctttctgccctcctgaccctatactcccatccccctatccccaggatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagctgtctggttcagatgataactcagagggctcaaccccaccacacctgccagttttctggacaaagaaaatgtaattgccacctcttcctgccctctctgcctaggaagagatggaggcaccagtgaggccatagtgagcaggtacttgggtccatgtgactgttaatttgagctgggttcaattctcaccttctccatgtcctaactccttgctctgtgaagaggaaagttacggtgaccag

SEQ ID NO: 17040 - DNA, 1624 bp, Homo sapiens
tggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaagcctgcttgcaaatccctgtaggggtggagggtggccgagctggggtgattattgggaccttggagaattcatacctcatcaccactgtctaggaaaacactgggagtgggccagggacacgtcacgactatgaaaaaggcatctaaggtattgcatatgtaacagtagaacatggagttgaagcaggtagggcaggctgaatggtgttgatgggttgagaagcagaaaggggagttagatttgcccaggaatatgaggaagcctgataagagggtggaggcagggaagtggagagacgatgtttgaaagacactggacggcccaatagaaccatggatgggaagatgaggcaaaggcccagtatggccatctgactaggaaaccatgaagaggagggaatgttcaggacggtagggggtagattttggaccactgagtaggtagagaaatcctttaatacatggatcaaattaagcagtggggccatagatggacctggaaatttcaattattagtgtccaggaagtaacagaaaccatgggcatgggtgaga

SEQ ID NO: 17041 - DNA, 1219 bp, Homo sapiens
atccacctgaaacgcttttcctacaccaagttctcccgagagaagctggacaccctcgtggagtttcctatccggtcaggggccagggagaggatggctgggggaaggcagggaaaggagggggtgtaccagtattaaccctctccccacccacagggacctggacttctctgagtttgtcatccagccacagaatgagtcgaatccggagctgtacaaatatgacctcatcgcggtttccaaccattatgggggcatgcgtgatggacactgtatgtgccaggctgtgggtggggcctgccctgggggttctgggcaggggggcgatcaggaccttcccagtgagtgactagggatgtgagccagtggtgaggttatcgtggtgggaggagtgacaagagtgaatctggacacttctgagaggcaggaagggtaggcgaggataactctccttccctttcagacacaacatttgcctgcaacaaggacagcggccagtggcactactttgatgacaacagcgtctcccctgtcaatgagaatcagatcgaggtgtgacttccatcctacctcctccccttcttcctttctgattccacctccccacccccacaatccacactgactcctgtcctctccccacagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctccccactcagcagtgtggttttttcctccatggacttaactaa

SEQ ID NO: 17042 - DNA, 1119 bp, Homo sapiens
aggctgaggcgggagaatggcttcaacttgggaggtggaggttgcagtgagctgagaccatgccattgcactccagcctgggcaacaagagcgaaactctgtcagaaaaaaaaaaaaacagaaaaaaaaaaaaaaaaaacccaggacattctgttcgtgcttcttatgtacctgacggctcagtgcagtgtgtactgacttccccattggtccccagcacagagtcttgtgtgctcctctaccctccaagacagtatgctctgtcccccttccctgttctctcccccgcaaccctgtgcagtgaagctgagaccttggcactcaagagtgagacaagcaacaggagggcctgagcagagaaggaactggaaggacttcagatgtgagcaggatctcttggactgtcgtgtgaaaattaggctgcagggggcgacaggagcctggactttgaattttattttgtcccctgccactttgcttctagactatcattattggacctctgaattcttgtctgccttcttgtaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgagtcatggaagcgaaatggcaggggctgtggatggacccagttgtaactctgggatcaaaagggtgacaacggttgggggaggcctttgcagaaggatgggaacatcagctgcgcttctgttgggcattgaggacccctacatctgcacatacacacaggtgactgtccgggatggcatgagtgtctacgactctctagacaaggccctgaaggtgcggggtctaaatcaggactgctgtgtggtctaccgactcatcaaggggtgagtgtggcagccccacgcccacccactgggtgtcccacctcccatcccctcctcagtcatttgattccttctgtactttatcacagagtcttccattagtcttcccttagtctttagtccccccttatctgcagggtacatgttccaagacccccagtggatgcttg

SEQ ID NO: 17043 - DNA, 1141 bp, Homo sapiens
agtggtataggggcaccaatgggaacctcccaggcagggtgagaggcatggctattaggagtccctgtagtggtccttgaccctggcggacatcttcctacatgaggggctcacggtgaagatcggtgactttggcttggccacagtgaagactcgatggagcggggcccagcccttggagcagccctcaggatctgtgctgtggatggtgagttgggccaggctggatggggggcacatggggacgtgggctccgggattggggtgtgtggggccaagtggggacggggatgcctgtgccagatgtgggtgtctggactcctcatgtcccacctcgtgtgggtggctctgagttgtaccctgtgtggccagtgggatctgggactgtggaccagccatttgctgacctccgtggtccccctgcctggtctggcctgttgtaggcagctgaggtgatccgtatgcaggacccgaacccctacagcttccagtcagacgtctatgcctacggggttgtgctctacgagcttatgactggctcactgccttacagccacattggctgccgtgaccaggtgagccccacaccttacccacagttccctgggctgagggatcccctcaggcatccataccccacatcccctcctttgcactgataaatgccacactttccccagaaacctaaaattttctaggataaggactcccagaatcccttgggctccagacacttacaataaattctctgggtctcccctaccccaacttccctcttctcacatccacagccctctgggacaaaaatctttgaagtccaaaatgccccgaatctctatacctagaatcccctgaggcccccaaataccccaaagccctctgtatccctagacgcctatagtcgtctgctctgggtactcaaaatcccccagatcctcaaagcccagatctcatttctcccagcatcccatttttccccagaaacagaacccctttgtgcttctggaatagtcatggacacccacagtcacctaggccttgggtatctagcaggccccagggccgggatacctagaaccctctaggccccagacccccacagaagtacaagctcccccagacccagaactccatgttttcc

SEQ ID NO: 17044 - DNA, 1592 bp, Homo sapiens
cccagatcacccctttcctgcccccgtctgcccccagattatctttatggtgggccgtggctatctgtccccggacctcagcaaaatctccagcaactgccccaaggccatgcggcgcctgctgtctgactgcctcaagttccagcgggaggagcggcccctcttcccccaggtgggctgggtagggggctggacaccttgggtgggtgactctgggatagaggaagactgagatggaggcagatgtgaatatgaaagctcagaggtatagtgtgtgtgtgtgtgtgtgtgtgtgtgtgtgtttcaccatgaggctgggactgttgggggtgtgtgtgtatgtgtgtttcgccatgaggctgggactgttgggtgtgtgtgtgtgtgtgtgtgtgtgtgtgtgtgtgtttcgccatgaggctggggctgttgggatgcccacagggctctggacacccctcctcacccccacctgccctcagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggcctttgcttgtttattttgtttcccgactcttctcttggggttcagagccgctgaggggtggggtgagtccaggcaaggagtgaaggtcagggggaggtgcggaccacataaacagcgtcactgcacgcatcaccacaggcggcacgatgaacgaggaccacatatgccaagcacggcacaaaaggaggccacgtcagtcacagacacagacaccacagcaaaggtggggaagcggagaccactggccttccgtgtgcaaaggattctgggaagatgggtggagtttgcatatttaaagacagctgtcagaggcaggaaactggggagggggtccctgggggaaccgaggggtcctggaagtgggaggggctcccaaggtattgaatgaggttgaggggagctggtgaagggaaatccttgtggggctaggtgttgggtggcatttgaagatgtggatcttcagagggatggaagatccatgggaaggggctcaacagtaggggtttcttgaggatttggaaaat

SEQ ID NO: 17045 - DNA, 1186 bp, Homo sapiens
gatctcgcctccctggcccaggactccacccactccacctgagtgctcccagccttgagaacctgttagggtccaggcccatggtggcaggtggggaggtcacaggcacagccccaggatcagaggggcagggctggggctgggcctggggtaacgttgtgtttctctccccttcctccccttcctcttcccccttcctcccacgcctccaccttgtctctctctagcaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtgg

SEQ ID NO: 17046 - DNA, 1162 bp, Homo sapiens
caagcctgttccctgatggctcctgatggcctctgagcccagtgactatcttgaagccccactggctattcctgtgcttaaactccttagccgccaaccgggtggggccccttactactgccagtttttccctgtcctttgggacaattccacaggcgacctgcctgactgacccccagggcctattccccagccaccattccaggacactgatttactggcttactgttacctttcaggacccagtgacatttccctcaatgggaggggctgtcctggggtatgtacttaggtggggtgagagcaagtctccccagcggctcagtgttgaaagctgaggagaggaagttctgctccacgggggaggcagggagaagccctcagagatgtttccctcctcccttccaggtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagacactgtttctgtgtagtgcctgggaacaaacccatgttgctgatgacctggtgtgagcaccctgggaccagtggggatgagggatgccaaatgttgggtttttatattttacttaaattctgatgtactggtagtaattctcaacattggcattagcactgatgatctgcaacagcagcaatggtcactgaacctgcattatcaaccgtaacctctgaataatttctccagccaatactttaaaacattttcctatactgattcctaattgctatttgcccagggctttctagttataaattatcccacagctgacaaatcactgccttactggaaattccccattcacacatcttgccagctgacagagtcattgacaaatgccctaccaattggcaaatgactatcattgcctcaagcacagtcctgatgttgtccagtgaggatgccccatccaaacacgtgggtgttactgtcctcatc

SEQ ID NO: 17047 - DNA, 1835 bp, Homo sapiens
acatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtgatgctggaggctgctggcactttttctctgatgttgtcaggactagctgagcgtgacacgcatgactgtgtgtggagggtgtgaggcagaggtcgattgtgagagaaacggtgtgatggcgtgtgtgagaaacaatagtagggactgcatatcggtaaccatgtgtgtgtcagagacgtggaaagctgtgattgtgtgtgagagtgtgcagaagttgtgaccacagacttttgatggtgtgtctatgtgggaaattgtggctgtgtttcagaaaataactgagcctggatgaatagtcaaggtactgtacaagaacctgtgatggtatgcacaaaataatgtctacgagaagggaacggggactgcagccctgtcactgtttgatggcgagcaagacagactgggtgaccaaaaccacatgtgagagactacgtgggcatgaaactacagtagaggt

SEQ ID NO: 17048 - DNA, 1183 bp, Homo sapiens
cagaacgagaggtcctgcttgtgaattactgtatttgtggccctcatgcttctgtggcttttcactggggccatctctttgctggaactggacaacttaagctgtgaaaaactagggatgggcaatgtttggatttatcaaaatgggtgggtgagttagacctgagaccctgcctgtgccctttcgggccttctttttaccctgagtaatcctgcaaggaaacaagccgtgggctcactttatgaactatttaaggtaaacctatcacattcagtgcctttccagggagaggaaacgtggggcagactggcttgctcctggtgcagtctccttgaaagatgcccaagggcactggaaataaagctatttttcctttctacttatagagaatcttgctagggtttcaggtccattgaaggccatcctatagtggggtgggggtgagggtcagatctcaccatttcaggtagatcttggactcctgcttcctgggacacaaatggcaagctgatggcccacatgtgggtgaatggaggtgagtgaagcacagacaggggaatggatggagatgaacatcagcatgtgaataaaaggattgggattggaggaagagagaggagggcaatgaagggctaagtggggagtgaatggagtaaagaggggcagaagggtggtgaacagggaagagtagggcgaaatgggggaaatatccagtgttgtgagttactggagaagaaacagttgagtgtaagtaaacatgagtagtgttggggagagaaggagggagtagactggcagtgagtgggtgcagagtggaggaaattgggagtgatatgaggcacagtgtgaatgacagtggttaatggggttgggtgaagagcagtgcaggaaagtggcaaagcatggcatgacgctaatgaatgaagaggggaagaatgccgggcagtcaaggtgggaagactgtgctggaatgggaggcactctgtgaggtgagtgatggggatctgtggtgtcagaggttataggttcttggggtctcagtgatgcatgaccttgcgttggtggtgatggggagttgggtggaggtgggaggtgatccctggggtttctgcacaaagaggagctgcgctgaagaccctgtagtgaccacaggtgtatgggatgggatcagcctgtgttctag

SEQ ID NO: 17049 - DNA, 1250 bp, Homo sapiens
agttcatggcacattagagagctaatcagcagtatctattatggacactgaaagaaagttgtgtcaattttactcacattttaaaagtatattttgacttgtggtttaaatatgggagtaaattcagcctttcttcttttcatctcagtcataacccaaaagctacgggagaaaaagcagaagtgtaatctctgtatctgacaaaattaggagacagctgcaaccctaatgagagggctgccacaggcagaggaaatgaagcactggtgcaggagatttcagagtgagagtgctcaaggctgcaggtgcaagacagcactggtaaggactcttagctgaggttcgggatataccccgaggcgcggaaccatagatataacagtggtaacagtgcgtgggcaggtaggaggtaggatgtttcctagaccatttggggtctgaggagaaacaggctggggcctcgagaaggagtcactcagacaagccatatttttagaaagtagtctactgatgggagcaacagttatggcatgctgggggaagagaagggacttttccttgtgaagagccctacagctgcccctatttactgacttgggagaagtaaagtcagaaagaacgaacagctgtggggggaaaaaattctcagttgtcaaaaaaaaaaaaaactgatctgcttagaatgtggccctggtttcttttcccacatgaacctccagcaaatagcaagtccaggaaaaactcttctcattcaaagaggaattattcaaaagtaatcaaaaccacaaatgcatttggtttttgggccagcaattccacttctaggaatgtacatactcacacatgtacaaaatgatgaacatacagtattcattaatgcagcgtttgtgaaaacaaaagattggaagctgtttaaatgacaccatatcagggttctggttccctaaattgtggtatattcatacagcctactcctgggtagacaacaatgaataaataaggagaacttggaaaccatttatgtagtgatgtgggataaccttcagtttatgttattaggtaggaaaaataaggttgaggacagtgactgccatttgtatataaaaaggagaaaaatggtaagtacataattgtgaattcataagttatctctggaaagagacatgagaacctggtaaccctgattaccttgggaggggaaggggcagtggtggctggggggatggaattgagagggagacaactgtatc

SEQ ID NO: 17050 - DNA, 1238 bp, Homo sapiens
aaggaaatgagtcctagagtgttgctagcagcactatctatagtatatgcccattaaatcgtggtacattcaccgtggagaactgtacaacaatgacagtgaacatcctgcaattacaccaaataacaccttgtagttattcattaaactgaacatatataggttttatgcattttctatatgtcatggttcaccataaaaggaggaaatgtcacaaaaatgttagcagcagagttagctaggtgtggtggcacattcctgcctgtaatcccagctacttgggaggctgaggtgggaggatcacttgagcttgggaggttaaggttgtcgtgagctatgatggagctccactgcactccagcctgggtgacagagcaagaccctgtctctaaaaaaacaaaacaaaacaaaaaaactttctttgacttttggttagctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaattttgtttcaatttaatatatagtaataattgtaattcaatgtaattggcttccattgtaattgtgtgtgtgtgtatgtgtatgtatatacttttaaaaatattctgtgaaggggttcacagatttaaccagatgccaaagggttctgcagaacaaatttatttatttattttgagacagaatttcgctctgtcacccaggctggagtgcagtggtgtgatcttggctcact

SEQ ID NO: 17051 - DNA, 1181 bp, Homo sapiens
tcaccttctctggcaatttttctttccaaaaaattaatttttaggagctctttatatattagggagataacaggtcagagaatgggatcactttgtttttaaaatgatttttaaagaagaagacaaaaactatatctggtcacctttcatatgtacctaggcccttctgcggggcctcgcctagagcagtcacagaaatgtccttgggcaaaggatgggttttcctaagaacttctttgtccttgctaagtgggaccatcacctctttctctcccacagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggaggcctgattggctggaaaactgaaggatccccattctgattggttgctctgagtgggacacagaggagagaaagcaagagagatgaagggttggtgcctatttatccttaggactgagggttgtgggttctaattggatgggaggtctgggatgggtctggattctgattgattgctccatctgggggcccactggtggttaggcgtttgattggctttttagaactggcatatggagattgagggt

SEQ ID NO: 17052 - DNA, 1150 bp, Homo sapiens
aggagacccctctgagcgcagtgatggggacttgcaccagggtagtgacagtggaggagttggcgggggaatgttgggtcggacccccagggggttcactatgttaggctgcaggactctgctgcctcctcagggggcgatattcccaacccttctgtgcattgtgttgtttattaaaagcagggagcagaggtgttgagtcctggagccccaagctggtgcaggagcaacgggaagttaaggctgacctggggcctcctgctgtgtggcggaatctccatccctcagaccacccctgtctcctcccagccccatccagggtacaaattccagccctggaacagctcagagaccaaaaagtgatgttaagtatttgaggggagccccaagagaggagaaaaagctttgagtattgatgggggtaaataaccaaaatcacttatcagtggcctgcgtcaccagaaaatgtcaaagttacctgaagcagcaaagaggctcttgctccggcccctcccttccttctcagctccatttgttgccacatatgcgttgactggaactgcgactgacatcttgggaccttagggtcagtccacagcgtggtagagactccagcttggcccagcattgctgagctgctgaactcgcaccaacagtcttgttggagggaaataatctcccgtttgttcagtccagttatttgacagtgtggttacttgcaccccaagcatttctaactggcacttccatctaatagacctcagggtacatggtggtgagatagggacatcagtgagctggattgttcccatggtaaaggtcatgtatgtgtgtgtgtgtcatggtcctcaataccagccccaagcccagtgatttgctaggaggactcccaagactcagtatgtggttgtattcatggctacgattgacttattacaacaaaaagatatggagcaaaatcagcaaaaagaaatggtgtgcaggaccaactcccagagagacccaggcacaagtttccagggcttctctctcattggagtcacacaagatgtgctcggttcacagtaatgggttgtgacaatacatgcgaaatgttgctgaccaaggaagctcaattagagactcagcacccagaggttttttttgttgt

SEQ ID NO: 17053 - DNA, 1099 bp, Homo sapiens
ctggtgtggggtggacgtgggatgagccctgggggagactgtcttcagacttcctctgactttactgggctgccttggtgggagagggtcaggccctctctctctccctgggccctggtttcaggcctcccacccctttttctgtttgggtcacctgagttccagagtatgacggggattcagattgagagggtaggacaaacgtggcctcccccttttagctgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacaggtaggcatttggagggctggatgagtaggtgttgggggtccctccccctcaggcactaagcctctacctctcgtttccccactgctagccaccaccctgaggtaccccagcgcatcttgcggatcatgtgccgtctggaggagctgggccttgccgggcgctgcctcaccctgacaccgcgccctgccacagaggctgagctgctcacctgtcacaggtcagaccccggtgcctggggtgggtggattcccaggactgtggatgaggtctcaggggctggaacttgggtttcccctcctggggagctgctgcaggacttgagaggggctgaagtccctgtcttaggggtggggaccagggaggggacagaccctcctcactgtcctgcgggtgctcctctctgtgcttccagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggtgtgtcctctgtgggctggggagaggaggacctggggggaatggaaaaagagagccatctgctgtttctggaggctctgagagagtcaagcagggcctgaggaaaggggccatggggaggggcacgg

SEQ ID NO: 17054 - DNA, 1249 bp, Homo sapiens
acccacgaaccagcccccagcattagctgcccaaggcccagggtccagttccctagcaatgacccagaagagcccagggcccagccccgagcacttgctcaggcctaccgggcagcccttgggaaccaggatcagacttttctccttaactgataggacccagggtcctgccactcagcactaaatgcccctgcagaccccaggggtctagcccagccctcttccagggcgtgagtatcgtcggttactgaggtgctgtctcctccccaggatcctgattgtggattgggatgtccaccacggtaatggaactcagcacatgtttgaggatgaccccaggtaagggctgcagtcaggggccgcagtgtgatcagggaggcgggtgagcacctcaggggtactggagcccctaaccagccatggtccgcttcccaccccctccctggcagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgaggtacagctcaggatagatcgcaggacgtatgtgacacgcctgtgcaggtggcagcctggacctgcctccttggcatgtgtgtgtgtgactaccatgtggctgatgatatgagacagcgcatgggtgtttaatgaggctaccagggcagttggtggctgtgatcaccttgtgtatttgtgcacagatggctgtacatgactgccttctctgtgtgacactgtgtgagtgactgtcttggctgtgtgtgtgagggccttctgactatgcaccaatggcccgtgtcctggctggatctgtgttgtatgtgcgtgccatcacaagtgcttgagtatgtgcgtgtgcgactctgtgcaggcaggtatttctcaccttttctctgtgtgatgggtgtgatactgtatgtcactaaatgcaaccatctctgtgacagcctgtgtgggaccttctggatgtggaaggctgtgtgtgacagcagtcactgtctggctgtctgccctggctgtttgtgtgtatgtctctgactgggaggtagctgccttccctctgtgtgagctaggaggctggtggcttgtgtatggctgactctgggagggagggaaagggtgtg

SEQ ID NO: 17055 - DNA, 2363 bp, Homo sapiens
actcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcaggtaaggctcaccacacccaggtaggggcaagaaggggcaagaatcgggcttctctgatacatctcttacttctgcgtgtccagggggcctcagaatctcaggccccaggagaggagaacctactaggagaggcagctggaggtcaggacatggctgattcgatgctgatgcagggatctaggggcctcactgatcaggtgagctcagggagaggctgggactgtggcttccttctcttgccaatttgtgtctccaggtaggagcatgtgatgaataaacatataatggggagatggggtcttcagcttacctagtttcacccacccactccaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtatggagcagaggaaggggatggggcggaggttggcccgggagcaaactgcagggggatgctgacccccacctgacactcacacccccaacctcaggtctactgtggtcgttacatcaatggccacatgctccaacaccatggaaattctggacacccgctggtcctcagctacatcgacctgtcagcctggtgttactactgtcaggcctatgtccaccaccaggtgggccctgggtagacccttcgacacgtgcacactcaccccccacacacacaccccttctgtgattgggtaaagggagaccacaggcccctctgcatggctgcctcatgtgattattttgcatggggcgggggctgtgggatagtccagaagacagagtggttgagggctggagtgggggcagccctgcagccgaggtagaggggtcctcactctctctcacctgccctattcttgcctcctcctcaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaacctggagaaagctttttgactttgagcaggtggagaaccccacatccctggccagcagagccgatgagtaatgaaggaatgagggagtgggtctctgtcaggtcaatcccctgcccatccattgcccccaaaaaactaactgaaaatagagcagccatcttgactggctccacgggatataaaatggtagaatccatgagaaaatgggtgcttgccttataaataggagcctcacagccagtcccagccacacccacaccctaggctgagaaggcaagaaaactagcaggaagtatccttaccaggcctgtttccccactgtctcattggcctgactggggatggtgggaggtccaggtttaacttgaatgtggtggtcatggtagcttcttggcagaaggggtgcctgccattgaccacaggtgggaaattggaggacagtctgagagctgaatttctcccacgtggtgagaattgctttggcagctcaagggagttgga

SEQ ID NO: 17056 - DNA, 1053 bp, Homo sapiens
gtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtgattgttcatttgacatgagacccctgaggcaactagctttgagggacacatcaggtatactagggaaagatggacatctctcttgttttcacttggtgaggggctttttggtaacatgggagtgcctaatgttgcttttgttatgtcaagttgaaagattttgtgcaaaattaaataaatggtgttttgggtttcaaagctgcctccatgccgagtgttgtgtgggtgggagtgagactgggtagaatgttacttgagttgtgagaattctttcattcaagaaattcagggggagcccactgtgtgctaggctccgctttatatataagggaggtagaggcaaacaagacacttaaaaatccttgcccttatagatatggcatcaggctagatagtgataaaggctacgtgttaaaggcaggtgaaggaatagggtgacaggtccaggaaagcctt

SEQ ID NO: 17057 - DNA, 1212 bp, Homo sapiens
gtgcgaacccctaagtcctggggcctaagagggagtgaggtcctggatccagggagtccaggcaaggatgcctggctgactcagtgggggaagtggaccccaggtcctgggaaggggagagggaggcggggaagccacagttttctgggatgaaaggcgatgacggctgtctactgaaagcagtgggctgaggacgccttcttggggagggaaccgtgtccccaggcagtatgtggttgtggatcctgcgttctgggccccgagcgtggggcgggggaacgccccaccgcggacaccgcctcactgctttgcgctcggccctgcaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagctctgtgcttgtctgtgtgagtggcagtttctaggggctggtggttccccgcggtggtggttgcccttagaccaggagagaggagactctaccctgggtcctgcactttagagcaatcacctgctcagtctatgtctctcctaggggtggaggggaagacatccacatggacaatcgcggatcttgtgtcccccttttaggcctcacttgggtatggggatcccaggctttgaggccactttcagggcctgcaccatcatcttccaagggaccatcctcctgagggccaaggggtggctttgtggggcacgtgagtagagcttgaggtgctggctgggatgtcgcaggcacacatgaacacctcctgatgtggggaagagaaaaggagagagcggagagaaagggagagggcactgagggtcgggaggccccagtacaggcacactctttggcagacaggcacattctggcagggaactctgagaaggctgagaaattggagcctgggtatccaggtcactaata

SEQ ID NO: 17058 - DNA, 1089 bp, Homo sapiens
acctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggt

SEQ ID NO: 17059 - DNA, 1678 bp, Homo sapiens
tttgccccagaagggtctggggtctaagtggggtttcacaggcctagcagatccttctgttttgagaaaggagtgagaagggccctatgggatttctccagagccccagatgtcggcacagggtgaggagaaggcaggctgagagcgctccatcatccttttcctcttcctctcgcccagcaggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttccctgagcgactctgttctgtgtggggcaggggttgggcgggcctctgggcagaggatgcaatggcacggaccttggcttgacctcagaggtgtgaatgctctccagcagggtctgtctgggggcctggagtttgtatttgatttgctgcttattaaacctccttctggacctattgccactggaaaagctgcgtctttgcctgctgaccccacccctgcctaccctatttcctgggggggggggggtgatggtagcagaggactgtgagcttgaacttcctgcctgaattccagcttctccgcctgcctctcaccatgaatgctgctctttccttatcatgatctgatgaagaaaagccttggaaaagtgcaactgatactttgtagcaacatgagtttagtggaagtaa

SEQ ID NO: 17060 - DNA, 1202 bp, Homo sapiens
gttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcaggtaagagctgtggggtgaggggtgagcggccacggcagatgggacccccagactgtgaagggactcaaggaaggctgtttgagatcgccccaagggatctaggcgttttcactgggcctgacagtcttctctggcggtagggatgtgagacaccttctttcctcccctccaggattttggggctagaggcctacggtaaggtgtcagacttaaagatccgaggtctcttttaaggtctatagtcgtcattccagtccctgggacctcatcatatagggccaataggtgggaattctccaagagatacaggtaggatcgcgcccctcttgagtaggagtctcaggtctcccaagagacttaggtatgtgttcagtggcttaagagctcttttcctctgggatagaagtttgagattccccttccaggaaagtcaaataaggtggagacctcggagatcggggctgaacatccccaaggagcctaagccctttcaagagtctgagacactctgcatataggacaatcctctcccgcttcgctgggtaacactgcacaggaccactgaatagccagacctgagac

SEQ ID NO: 17061 - DNA, 1493 bp, Homo sapiens
ccagacatttttcctggtgggagctgaagcactgggcttccacaggcccctggcctccttgccctagcacactgggactggccccactctcccagctggactcctgcatgctcctccccttgggctctcagatgaaggcaaagctttgatccgacatctgagctctagcctaagaaggagagttgagatttcctcctccctctggctgggatatggagctttggaggttcagagaagagaaccctcacctctgatctggcctctacgagaggtcctcatctccatctggcccaacaattcccagattctgaagcttggaatgcaaacacaggcttcatgggctgtggcctctgcagcgacctgccatccccaggccttgcctgaggggtcaggctgcctctcccaacacacactcagatagcacaaattctaccatccccttccctggctgctggaaatggaccccgcaaccctgtcctctgctgggcccccagcaaactctagcaatagcagctgctgccgtgtcattatgcaaagcctctgaccagtttgctgcagcatttacatctgccctaatcagaggggccacctctaactcctcctcctcctctcttctcctctggtttgcgtccttcctgggttgggctggagtctggactggctgagataagagcctggcaaccagcaagagctgggctgtatttggagatcatgggctgattccatgttcttgggcaacagtccagaagcatcaggggctccggcctgggatgtttctgaactttgggagttataggagacaggaggaacttctcctcctcctcctcccctacaattccttttcacatattcctttcttctccctcttgggtgaccttccaaaactctgctctcaggctgaaatctggcatcatctcaggttccctgtccccagcactgtccccatggagctggtggctgacaaagatgtagtttccatcagtcaataaaacctgagaggagagatgaggactgagagtatctcctggctctgtgggtttgggggctgggttgggcttgggggttgaaaacactctgatttcaatcccttttggctaggagaagggctggtatgggtcaaggtatgggagatggatggttggtgatgtattctggaagatggggatccaggagaaatgaaagagtgtggtttgaggagttcatctacagccaatgagacaggccagggggtcctgagacattcctccttggatatcatctgcgccagcttcctgattcacagatcgggaaactgagacccagagaaacacatagttagttagaggaggcttaaacccaggcttcctgacagcaaacaaccctgaatttaaccctaataaaagcatcactttgtttggtgaatttcccttccttgtggacgccccctacattctctcttctgggctactggctacactaggctagtgtgtggctgagttctatagagcactgag

SEQ ID NO: 17062 - DNA, 2741 bp, Homo sapiens
cacccagctaatttttgtatttttagtagagatggggtttctccatgttggtcaagctggtctcgaactcctgacctcaggtgatccacctgcctcggcctcccaaagtgattacaggcgtgagccaccgcgcccagcctaggggccattattatatacccactttacagtttgcgactctgaagcttcagagatgttaagcaccttgcctaaagttttggaactagtgagtagcagaagctgaattccaacccagggaacctacccttttcaacctttatactcctctgcctctgagggactctgaaccctacttatcctgcacccaacccctattttttacaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaagagtctcctgtccttgttttacactgtgcagtgaacatagcccatgcaggccaagagggataaaagtccttgggagaaacagattccagaaggatggataaaagaatttagaaaggaagagggcatggaggaagacaatatgcaaacaaaagacagtatttttaaagaccaatcaccaggcacaattttaactgctgcaagtgtttcatctaatttatttctctaaagggatgttagtcagaacatgctgcttcttacttccatttggtctttgaagaagctgaggaatagaattgaactgttctgaagatatgcaagcctgtaaatgggtgaggcggtaaaacagtaaagtcaggtgagtgagggctcgattgaaaaatgccactgagggcagagggggaaagaagcttttcttgcaaatccacttttgaaactgataaagaagtctatgaggatatttcctggcagacaacagaggtatttaagatggtggaaaggacaaagacaaatatctgaaagg

SEQ ID NO: 17063 - DNA, 3183 bp, Homo sapiens
ttacggcttgacctcaggggcggggcatggagtttcctggagaaatgtgaccctcttgggcgctgacaggaaggaggtggaatccaactcggatccttgtgacagtccctcctttcttatctgtctggctactttgtgcttgagccgctggcaccgcccggagcagcccctgcggcgccccgcgcgggggtggatggcagttttaagggttgggagcatctcgcttcgtggcaaaggcttgatttcccggcagcctttgctgctttcctgagcggcgtgttagttgcttttccggtcacgtgcatcgccgcccctgcgcaatccacctaggaggttaggaaaaagctgcccagcccagactccatttcccggtgtgccccgcggtggcgaggggcgtaacggttgttgtagtccggccccctcctggctggtccagccacattaaccggcaggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccgggtgagggagggaggcgccggttggccagggacgtctgcagagcgtgggggtagacccacaggtctttgaggaccaggacggggaacctgagggaggtgcaaggccgggaagggcgaagtcagtagagatggacggcctgaggggcttggaaggggggccttgaaggaggtggagcctagttataaggagggcctcagggagatggagcctggctgatgaggagggcctgcgggggatgggggtctgcaaggaagatatggggaggatggagacaagtgtgggactgaaggggaaagtgggctggaaggtgaaccggaaaaaaaggagggcccgaaagggggacatgagagtacttgaggggcgtagggggggtgtgatgtgaatgatggggccagattgaggccgaccctggagtacttagggcagagaccgggaaatagacggtaaagttggagggtttggaagatgtatttattggggatccggtcttggaggggagcctggctatgattggaaggcgccaggggcaggtacctgttggggaacttgggcccaggaggaggatccatggttggaaagcctgagaccagagagggatggagaatctggaggaaggacttgagcagtgctgaaagttcagagtggggctgacgacctggaagaggtcctagcaatgatggagggaggaatctatagggaaatgggagcctggagggcggttctataaggaccctaggcctggggagaggggaacgtgtgaagacagaaggcctgaaagagggatttgcaggggctggtgttaaagggggagcttgcgggcaggctgatgaggggccctacgggggcagagtcggaaggaaagtccagggaagtgttgggagcccgggggtgtggggagtgtctagcaggatgggagggcctgaagcggggacctgaggaagacaggacagtggaattgacaaggaggaaaggaggggtctacaagggtgagtcgggagccctggcagatgggcctgctggagatagggctggtgggaggatgtgccaggctggagtgtccggagacgggagaccctggctcttggggcccagggtgggtggtggtccggaggccgtctctccgcccggccggctagcttggttcccttgtacccgcaggtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttcgtgagtctccactaccccgagatagccaggaaagcagccagagcatgcttaaggcaccaggccagccctgccggtccccgggttgagagggggctgggaaacccgagggcctcgccacgcccccgctaaaagcgccttcccgggcttcgttcccccttctgggaacaccccttttattatcgcctttcctatctcactcttggtgttaagtgccttccactggccacgtccccgttaccgggcgtcttccctggccatgcccacgttgccaagccaattactcggccacgctttcagtatctgaggcgtcctggctgctcaccactccattggcctgcctgcgcgccaattcccttcggtgggccccggttggctgcaggctgaggtctattccactgaccacccctctcggtgccgcccacagtgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacctaggaccaagagccacctacatccagccccaaaactggggcttcaggccagagcatccatggccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatc

SEQ ID NO: 17064 - DNA, 3183 bp, Homo sapiens; identical to SEQ ID NO: 17063

SEQ ID NO: 17065 - DNA, 3694 bp, Homo sapiens
agtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattgtgagcgttctggggcaggcgcgtgggcaaaagcgggatggggtggctggaccatgcggaactggatggtccgggtgaggcaggcacttggccggggcgctcggcagtggggtgcaggtgggtgggttcacggtggaggcccgaaacccggggcgcagggcgagtcggtggggtttgacgaaggttgttgagatctggtggtccccggggtgaagcaaggagcctataacgcatacggagggctacgtggggacagcctgcgtgaactcatcagtggacgcatcgaaggggtcccagggtgctgggaagtgggggcctcctgtggcagggcgtggcgcggcctgggcacaggagggcgggctggcagcgcgcccaggggcagggcctgttggggtggggcccccccgccccgcgctagtcccgcggtgtagagcgccccgcccttcgccagttcttcctcgcccttcagaggccgggcgggatgtccttagcttttcggggtttccacccttctcaaagtgggcgccgcctttgagtcacttgtaaaaggggtgcggcgcctttaacggagtcctgcctctctggtgtcactctcaccgcttcccaaaggggttgctgggggaaccgcgtgttccgccccggtcaaggccacaaagctggcgtcagcggggctcacaaaacacctggcagcgccactcccctcaggctgcccgtaacctagaagggaaaagaggaaactgaggcacccaactctactccttacttgttgggtgaccctggccaagccattaaacctctctgtgcctcagttttctcgtctataaattagaaagagtaataatagtacccagagcattagattgtcgtgatgattgaatttggaacacagtgagcacataaaaagtgtttagctattattgtatgtcatttccccagccctcgtaggcatcttagtatgggacccccaatttaaaccaatcttctcagccctggttgctgattgaggtcccctttcccatgtcacccttccagatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgagaaggggtccacaatggcaagaccagggaggggtctgggcagttaggattgtcggggaactgtggttgctgacttccctcttctcctccctacacctcacaggatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcagacacaaggaccttggtgagaggtacaaacaggcggcccctttgtcaacgcactagactaccatctgcaagaactttgtcccaaatgtagtagaaattggggccgggcgcagtggctcatgcctgtattcccagcactttgggaggctgaggccgaggcaggcagatcacttgaggtcaggagttcaagaccagcctggccaacatggcgaaaccccatctccactaaaaatacaaaaatcagccgggcatggtggtgggcgcctatagtcccagctactcaggaggctgaggcaggagaatcacttgaacccagaagacaaaggttgcagtgagccaagatcatgccactcactccagccccagtgacagatgggtgacagagtgatactgtgtctcaaaaaaaaaaaaagtatgacttgaattgtgccccctacgggtagggccacagtgtggcctccctgtgttgagaggtataggaggagggagagtggggtaggatgcactctcttggcctttccctggcttaccaacccggtgcttgagtcccatcctgcgtggggcaggtgctggaggtggtggatacaagaagataagagactgagtaacctgaccagctaatctaaaccccctcactcctatcctgtcccccaggtactgggcctaatcgctacgtgcctctttggctatgatgcctatgtcaccttccccgttcggcagccaagacatacagcagcccccactggtaagtgtgtgtgtgtgtgttggttgggggtaagggggttgctgagagggcagagggaaaaaggaaagggatctcttaaaggcacgaatgccaactctggtctcgtattggtacttagggcttttgtaccaataggtaccataagcttcggtattcttgtgtgtaaaatgttcatggactttggatcttgttttaaaaaatgggcatatagattcagccaatgctttctctcttttcctcacctgcagaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatcaaatgtgggtaaatttcaagcatcaggagggggaaatggagtggaaacagctggggcaaggaggcaaagaagccaggcctgttttacaacaaatattaaattacttcaataatacaaacgagaggcccggtgcggtgg

SEQ ID NO: 17066 - DNA, 1201 bp, Homo sapiens
tgtcttctgcctgtgggctcatggcagctggaatcttctcgacggctggcagagatccaagaactgcaccagagtgtccgggcggctgctgaagaggcccgcaggaaggaggaggtctataagcagctggtaaggcctgtgtgagggacctgggtagcttaggagggtggggggatggtcctggggcagtgcctgctatatccctgcctagatgtcagagctggagactctgcccagagatgtgtcccggctggcctacacccagcgcatcctggagatcgtgggcaacatccggaagcagaaggaagagatcaccaaggtacactgccagggccatggagggtgggtcatgtgggctgtcaggcatagtgtggccgcacagggacctcacaccctcaggcagagctgtccagtcacactctaacacagaatagtcacacacaatccatcccagtcacccctgacacagtgacacagtccctgtctggtacacatgaggaccctccactgctagccagcctgccccaggcaggggctcatggctgccatggtgtctgccagatcttgtctgatacgaaggagcttcagaaggaaatcaactccctatctgggaagctggaccggacgtttgcggtgactgatgagcttgtgttcaaggtgtggggcaggttgggcgggggtgagtggggtgaggctgggctgctgccttgtgcatctgctaattggctggctggggtccagacccaggccctgtgcgaggctggaggtgcactgatacccagggctggctttgtttcatggaggatgaagctagtggggtggtgggagagggtggccttcttagggcatggagatggtcaagggcagcccactgatacctttgaggtccctgtgtctggtcaggatgccaagaaggacgatgctgttcggaaggcctataagtatctagctgctctgcacgaggtgaggggagacatgtgcctggggtggggctgctgggggtgggtgggactgggtgcaagccttctgctcctgttgtccccagaactgcagccagctcatccagaccatcgaggacacaggcaccatcatgcgggaggttcgagacctcgaggagcaggtgaggcctgggggcaggatggggagccaaggcgggccggggggacagttcctcaggttatgctgacagaggctgtggagc

SEQ ID NO: 17067 - DNA, 1086 bp, Homo sapiens
aggaggcagaggtgggaggatcacttgaggttaggagtttgagaccagcctgggcaacatagtgaaaccccaattcgacaaaaaataaaaagttagttaggtgtggtggcacatgcctgtagtctcagctactcaggaggttgaggtgggaggatcacttaagcctggaagatggcagttgcagttagtagtgataatgccagtgcactctagcctgggtgacagagcacaaaacccgtctcaaaaaaagaaagagagagaaaaaagaaaaacagaaggcttcttgtagatgttattttgagaactctgaatcgtctccattgtgaccttgctttcttgcaatctctggggtctgcacagttgtaggtgagacctcattgtttttggtaggtcagcttttcctggaaaggcccataattgtaagaatcctgtattttgcctacctgagtagactgtgtctatttctttgcaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattggtaaggatttcagaaaggggatagtggaatccactgtggaactcaataaatatgcctgaaatgggggaagacagggaaggggggactggttaggagccagaaggatagagctagcacgtccatcttcaatttgttttttccttctgtttgaatagaaaatgctcgaaagaaacaggatggggttgttagcacttccatcatttatttcacggagc

SEQ ID NO: 17068 - DNA, 1087 bp, Homo sapiens
ctgattataagacaatgctgctttggttaatctcttctaaatgaatttagagagattgacttttatagcttgcttgttgctggtactcttttgaagtgcacaaagataagttatagagctttctccttgtctgcaaaaacggtaattttccaggtggcatttgttagctggtagacaaggactttgccgtgaatttgttagtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatg

SEQ ID NO: 17069 - DNA, 2331 bp, Homo sapiens
aacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagtttaaaaaaaaaaaagatctctgcctctcttctctctgcctcgtcccaccttgctgtctgtctcattgtctttctctcccctcaccatgcgctgaattcagatttctctttcttttattataggcatgttgttttgaatgtggactttgtgggagggagaggattgttctgagaacagaaactggaagatacgtctgagttgatgggaccaacagggctttgctcctctgtgagggccaaagccattgatacttgtcgggggtgatgagggctttagcatctcaaggcagacatatgaagtatttactgctaaactatattacttactagtacaaatctgttggaattcaggggcagtctaagatttggtgagtgaaatgccatctggcaaaatcgagaagagagtgtggcctgagaggggaatgttcagcctcactgtcacattaagggtacctcaaaatacatggtccttccagtgtgttccttttccttcctccatttcactttgtcccctcttcttcctttctctcccattttcctggctttttagcactcagcttttttttataagtatgtatttactttttattatatatttggtcctttgggactttgtgatgattaagaatttattccattcaggattttaaaatgatgtgtttaatattttgttctcttaaactcttttgaagctatgctgctaaccaggtataggccagaaaggaggtggcccagtcagtaccttgctcacgtcagctaagggggacagtgatgtcatgtgggtgactcttcttcatttgaccaaggccagcctcctgttcttacctctgcccattcatttctggctatgggaaaactaccacctgttgagtgagccaatgaggccaggaagatcagaggggctgggttccggcccatgggccactatttgaatttctctgtagtaagctctttgtagggctggctccaactgcagtagccaaagaaaacctgtctgactcgacattttaatgcctgagagttggtgaaagttcagctgaagctaatgtctagacatcagcagtaactaggcatccagaaagtagcttcaaccaaagctaatagagcccaagtttccgcaggaagtttggtgctgagctgtccagagcagttgtttatctgagtgttgctagcccttagccatgctttcttagctttattctcgcctgttcctaggcatagcctgaaccagagctatggctcactgctcgctttattctactccctagtcatgcggaacaacatagtctaaaaaggaagatgtggactggggagttaggagacctgatttctattccctatgcttctactaactagcctcgagatcttaaccgctctgtgcctcagtgttcccatctgcaaaatggggatagtgttaattgccctacctacctcacagggttgttgtgaggataaactgagacaatgaattcaaagcaagttgacaagtaagtgctatgcaaattgtaagaaatggaaacaatcatgttaaaagcaatggaatggacattggcagaagggttaatggattgtccagccctttctctgtgtggcttaaacccaggtcgccattgctttatacattttcacttagcacagatttgtaattatgcatgtaataaagcacagccttatccaccctggtgtctggtgtgtttctaaagaccctaaacttggtagctattgatttctgatcagaaaaccacaggggcagagtggaaggttcaggggagggtagcacaaaacacaactgcaaacccctactggcaggcccactgcttaaaaagatttattaaatagttattttcacatttacagactcagtaatactctttaccataaggaggcaaataagaggcagcttgcgtttttggagatgttccagatacccggatacctcattcattgtggctacttaaatgttcctgtctc

SEQ ID NO: 17070 - DNA, 1218 bp, Homo sapiens
gggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctctt

SEQ ID NO: 17071 - DNA, 1211 bp, Homo sapiens
ggagattcagatgaagcttctgttttttttcaagcccttgacccaacttcagtacaacattaggagcctcattcagaataagaaacatcattgatatatctctcaactcaaaagagttgcatagtaatgagctcttagtgagctcagatgggaaagggcagctttgaaggaggatcttgcaagagctgggacaggcaggaagaagcctcattctggaacaactacactactgtagtggcctcctcaatggtttctttccctttgatcatcccctcctccctcccttaaaattatttaatggttccctgctgcctgtagaatagagcccaaactacttttgcctggtattacagaccattctccatctggctccagtcttagcaatccttccaggccccaggttttcaggcagaacggttacctctctgttccccaaacccacctgggaaattctggcctccgattttctcaccatgatgttctttccagtggctagacttcacactgcatccttggaaggacttctcacttctctggccctctccataggacctaaccttcaagccctacctctaagcctctagggcatcatctttgattgctcctggtggaagcaatcagaacctcccctctgaaatgccggagttctgattttccagtagctgtctttgggtactttggctgtcttgtgtttggtttgctggatcaagatcttctagacgacaatggctgtatcttctatatattttccatagtcagcacagagtagactctccatcatggtttgctggtttagataatatgtaagaagagtcaagcaaaaattttttactccgtgattggtaatctttcccctttccacttccaagcctaaattagagaatatgactagatgatctggatatactggccaagtttcccaaactttgtgtgacaccccacctaagtggggtgagccttgaatgacacacacatgggaactagaggcagagggaacacttagaagaaaataatgttggggacagaagttgagaaggatcccagaggcaacccaggatgagaaggagcagtagaggatggggttggctacctgcttgtccccaggctgcctgaagtttggtttataacagttgaatttcatgctgctgctggagttcctgtgtgtaagctgtgttccgaggtttgcatgtgggagaggccggctggctgat

SEQ ID NO: 17072 - DNA, 2250 bp, Homo sapiens
aaaactctttcgtgggtgggaatcagcctgaattatttccatgagtctagagtctgtaacatggaatttaggatattttatgtcttaaatggtcactcctcttttacaaaacttctgatatcgctgctttcctgacttttttacatcatggtatacattggcttataacccctcagttgctgatccagactcattgattgcatctgcattagataattctgtggaagtgaagtgcttgatgcaaagtgattgatgtacataataagctcttggtacatttgtcagttggaggaattattaacataagcctgctaattgtgtgttggtttgtttttccagatgaacagcaaagatgttcagtattgtgctgaaagaaacattgatgtgaacccagtgatcagtggaattgtcaagtacaggtgagcacttctgtgttcccaagaagacagctcatctggtttcttcctgcatcttgggacactccttccctgtctataccactgactcttgctctggttgttgtactcttatacgtgaatagactcttaattcagcacctatagccttttgttgtgcttttttgatgtgtctgccttcattagactatgatgtctttgagagcaaagactatttttccttactctttgcatattctgcatctgagacactacttgaaatatggttggcatcactgaaggttctttgattcaattaatattttgtaatcaccgtgtggcaaaacattccccttccaatctggtgctagtagagtatatgctatctaggcaccatgtgtgtggcttttgtgtatcaggtgtttcagaaatatttcaagacagttgtaagatgtttgaggacaagaattattactcctatttctatgtcataccacacagtagctgcacagttttaagattatgccatcacctagggtaatgttttgtagaatcagtccttcgtgtaacaactctagtgtttttgtactgttgatgatttgcttaaattttattcaaaaactatcacttgctataaaggtaattgtaaaaataaatacagtggacgcaaaataatgttgtgagtttttataaaaataaattttaaaatgatatataagacatttttttgcaatgcctgccctaaccacttcttacatgtcatcttaacatctctttgaggaaacactgtttcctcattttacagatttaacatactgtattatttgatgccagagccaacaggctatatcataggcagtttccaaacttaattatgccatttagtttgtctagatttcttttgcctctctcactgatccatttggctgtagttttcatcccttttccagtacacacagctagctcctcatcctacctggtttctgcatatgagaatgcagagggctgagagagggcaaaattgttgtcatttagaaaaggcatttaggaaagaggctgctattagaggggaacacaaagtgaaggtttttttaaaaaagaggacttgcatcagctgcctccagaacaattttaagaaaataacaaagatgtttagaagaaatcttacggagtttgccatgggatgtgtgatatcagcagtcttcagctccttacaaattaccaaaagtggttctaatatgctagtttgtttgattttttcttttatattataaagcaattgcatcgataaaagcttggactccattttagtgtgacactcttcctcatgataccagtgaaatgtattgattgtgtccccagttgttacataatttgaaataaaaatataacttcttgatttattgttttttaagatgtgatatggtactgtggttatgttgttttaaaaaatgattatcttttagagaagtatactgaaaaatgtacaggtgaaatgatatgttactggtattcgcttcaaaatcatctgagtgtggggtaattgagtacatagatgaaacaagattggccataaattggtaattgctgaagctgtgtgatggatgtttgagagttcattatactattctctatacttttgtatatgtttgaaattttccataataaaaattgaaaaaagtattcttcagagtttacttgtaggccccctctctcctagacttaagtgcagaaggctgatcagaagacagatccacagcccagaaagattgattcctcctctccgaaaacctagcttttgttcttgagctaaacttgtttgcagactgctcttccgttagtgtgaatttttcct

SEQ ID NO: 17073 - DNA, 1047 bp, Homo sapiens
cagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaaggtgagatctctgctaacttcattttgctttggggctgtctcctttcttctctgagggtgttcatttgttctaaacaaaacaatgtatgtaactgtattcagctaggctatagggcatttgaagagaatgtttattcctgtcctccggatgttcacaaactgatggggagataatacatggacacaaataatatatacaacctgtatgtaattcagtttacattttgttatgttagtaaccaccatgtgttaagccttgagctaggcacattcacacaggttgtctcattaaaccttaaaggcacctcctaccaggtagggatcatagtgccaattttacaaagaaggaaattaagtgccagagaggtgaagtgacttgagtgatttgttcagggtg

SEQ ID NO: 17074 - DNA, 1177 bp, Homo sapiens
acacagaacccactggtgattctgaacttctctctgatgatgcagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagtaagagctgtaactccccagtcacttttcccctctcttgctcttttctttgtcatcctctcatctgtaattcaaccaagtttttttgtaaatattttataagtttaatgatttcctttttccctcccaggcaaataagttggtcaagtacttgatgcttaaggactacacaaaggtgcccatcaagcgctcaggtatgcatccagtgtcccctccccaagctctgcccttcccttcactccatgctctgtcagcattcttctgcttgtagctctgcccttcccttcactccatgctctgtcggcattcttctgcttgtatgacccttccccttctatcccctcctttccatggttggctctttccacccttgaggaccttgactgtgctacccccagcagggctggcaaagggactgctgctctgtggcccccgctcggctcagatggctccctcctctctc

SEQ ID NO: 17075 - DNA, 1187 bp, Homo sapiens
tttcctcatctgccaaatgggggtctgataatgtgtacctgagacaatgcatgtgcattactttgccctgcacccggtccttagaaaattttcaataaataatgactatcttgactgaaaagaatattgtctctcttggtttctgtcttttctctgtctctgacccttcctccattggatctttctgaatgcttctgtctttctctgttactgtttttcctctttttacccgtctctttctcaaccctaaagaggttagaggtgcatagtttatagcaataagttttacccccgaggacatgagcttagcctggggctccgacctgttctgtgggtaaaaaatggagcctggctttgggttgcttctggtgtcattgaagagagaactctctttgctccccagcctactctgttaaacaggtagagacacccaaagttgggagcaacttagattaaaaaccactttttaatagccccttatcctatataatgttagtcaccacaggaagcccacagatctcctggttatgtctccatacagccctggacatcctattttctatttccatcctgaaatcctttgaccaggccttaaggaactcaccttcagttatcagcaaaattccctccattctcatcctggcttctgaatactccctttattttcttgctatgctttggtcgttctcatacctgttggacccaacattgctttttttttttaataaggtgtattttgaaatgcttcactattctaaaatgaaatggatagaaaatagaatctgtctacacccataattccctgaaaaccaatataatgccctaattgtaatatagagagtagtaaaggaagagtaatatataatattatattatacatatatcgcacatatatatgcaaagactgggatatgactccattagaagacatgatgaaatggtcttacacttaatgatagtgacagctacatgtgtgttgattggtgattcagaagccacaggtagagtgacacagttttcctaaataatgaacaattcttcacaaagttctaaacaaaacaatgtggaagagtttctcagtttatatggtcgttaaatttctggaaaaatcagtatatattaatatccatgatgagaccctcttaatctccctgaccttatctcccaccactctccccccttgctca

SEQ ID NO: 17076 - DNA, 1241 bp, Homo sapiens
ttcatgaaaggcagcaaatgtttgcagctgaactgtttccccagtttgcttcctgccagtagaattttgggggtccagtggctttttttcattttgtcttgtctgtaatcagctgccaccaagaaatagttccacaggggggcttgggttactgttctgttggcaggttgggcactcagcagtggcttatagccagattggtcgtggtggaagtccatattgtggagtccatgcataacctccatgcctgccaccatggccattttgttcaggaatccattgggcaaagaaaagggtgacagataagaggctgactgacatcacagaacaggacacctacctgtctacttgattgagctcctcttctgcagtggactctctctggtgcttatttatgtgggacgtgaatatctctgcccattccaagagggacagccatatgctcttcctcagaccttgtcaataatatttcagtcctgttatttccaagtccttcaccatttagccgaatcattaaaaactactcatgaaacagtggaaacctatctatacctctgaccagctatgtgaccaggcagttgttctactgggagaatttcccttctcactgtccttcaggatcaaccctaagtagggctgtaacactacagctagctacttcagcagggccagcatatcatgcagggctatgtataaaccaagctggaatagaatattgtatcccttagtcacctggtcacagggaattccccatgaggcttcaggtgtgggtgagagagggatggcagtacagcagttgggagtatgattcacttgctcaggcagcttattcatcatctaggcctgcttgtataactctattctattcggtggtggagtgctactgcacatagataacttcgtggcttgatgagacagttaacacacaactcaccatggggagctcagcttgcctgggtcacttggagtcctatgctcagccattcattcacaaaatagacccacttttccatttttatttttctctgctcctgggactcctgttgtcacgatattgccacctccaattttatcccccatttcttgaatctttaacttgctcttcagctgtagtcctcctcccctttatgccatctatactgtgtagattcgaatagtatatccaagaactggagaaatcaccacaggatttcttctgggcccagtgtaagaaagactcagatcaaaacttcatgtataac

SEQ ID NO: 17077 - DNA, 1982 bp, Homo sapiens
aacctgtctttctgcctgtctgtaatcacagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtaggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatctactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtccttt

SEQ ID NO: 17078 - DNA, 1274 bp, Homo sapiens
ctgggtggccatgagcagaccgcttgtcccctgagcctcagttctcctggtttgggagtgggggtgttaagggggggcccagagaagggaaggggtaggctgctgacccactttgctcctgtcctgggtatggcagatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtgagctactcagcccagctcttgtcctcagattcttgtctcctagcccctaccccagtttaggctcggccctgccccttgttctccaattttcagttttctttggaccagccttcctactccattctgcatctgtccagattcctagactctgctccctgctggcagcctgtgtcttccctcctcctccagaaggcggagggtctcaagtttggggttggcggaggaggaatagggcctggttcttcacttcagttgcccctacctattcttgctctcctccgcaggtccagggcttactggagaatggagacagtgtgaccagtcctgagaaggtagccccggaggagggctcaggtaagagaggtaggtctaggtgtggtgtgggtaggctgttgactgcacatcaccatagtgacccatgtagtcctcagctctgttgtagtggtggggataagaccaagggcagcctctaatgccgcttgttcctgcaacctcctagatctggagctgctgtcctcgctgttgccacagttga

SEQ ID NO: 17079 - DNA, 1136 bp, Homo sapiens
tgatctggatcttacctgatttttcttcctctataaaattatctgactcagcgcacactgatcttgccctggtttatctgattccccaagctttgagagtctagactttacaaagggcaggtatgctccctggggtttggcctcttaaaccccatgaccctcagcatagatttgaatctaaagtaggggtcggtggtggctgagatggaggattttgctacctggttctggttatatataacgcataggttaaatgcccttagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtgagcatgggcctttctggaggaagtggggcaagaaggaggatggagagctgggccagacatgctcttgcctgccctcttcctccaggtatcggtataccttggatgagcttcctgccatgctgcataagctgaaggttcgggctgagtcctttgacacctgggccaacaaagtgcgagtggccctggaggtggaggatgggcggaagcgcagtgagtgatgggggggatggagggactccacaggcaagttctattccctttcttctgtactctgacccccttcctctgcctctattcaatactgcctactctttgctgccctcatttttcttccaggccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctgggtatgacagcgtgaggagttagggcacacataaggtgctgaggatccagcaccgaggaaaagtgctgcaaggggtagactgtgaataccatttggcagaatggacatcagcaggaagctgccaggcacaagagtgtgagatggcctggaaggtgttgggggggacaaggagaccaggccacctaaaaaggagaggagagcctct

SEQ ID NO: 17080 - DNA, 2301 bp, Homo sapiens
tctctactaaaaatacaaaaattagctgggcgtggtggcgggcacctgtaatcccagctactcgggaagctgaggcaggagaatcgcttgaacctgggaggcggaggttgcagtgagttgagattgtgaccctgcactccagtctgggtgacagagcaagactccgtctcaaaaaaaaaaaaaaaaagaatcacattttagctagagaggaaaaatggtggcagaagaacacaggatagcatattaaagtcagagccatttagataaagtcctaaaggaagaaaagagcatgagatgactccctggaagttgtgagactggaattgagttttgaggaaccaatgaaagaaagtggaaaaggacatttcagtagggaggaactgagcaaaagcatgatggggaatgaaaagactaagccgaagtggtaagagcaaaaggtacagctgtaaagtaaggcctgcctcaggggccttgagtgcagacctagggctcttctccctccctaccccttatattccagttccacttgggaggattcttcacctctttgcctctgttttggtgacatgttctcctttgggtttcaggagtgtaagcggcccccagaagcctttggctttgagcaggctacccgggaatacactctgcagagctttggcgagatggccgactcctttaaagctgactacttcaacatgcccgtgcatgtaggtgatggagggctgaggtagtgttgggctaggatcataggtattgatgccagatggtctcagctcacctggatcagtgggtccagggtgtgatgggccatagtcatctgctacctgtcttcccccagatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggtgagtggatgattcatggttacgtgtcagctgtgtgagcttaggcaaatcatttagtatctgaaaaactcagtatctctgtaagatgaggataattatgcctgtcttatgtagccatgagatttagatgagatgaaagaaaacagtctggtacctggcatgtacaaacatgagatgggttctttcgcctctgtgagcccatttccttatctttaaaatggggataatatctactttgcaaatttgttataaaaattaaatgagaaggtatatgagatcctggctcatccataagtagtgttcagggagtggggtttgtatgcacaggagaaaatgagggcctagttgtgcttccaagaaagggtacattttgatccagagcaggatttttttaacttgcaggtattttggtaggtggatatatcggtaaacttcgtagaaattgaagtgaatacaattgaaattttgtgtgtatgctttttggtggagaggtagggagaaaacctatatgtttcttaagatgtttcaaaaaagtctctgacctcaaaattaaggttccctaggctaaagaaaatgacttaagatctcagttccttagcataaccctcatgccctttttacaaatacctgacctggcaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggtgagtgggaccctggggagccagggaatcaagtcagtgtgggctccctgcatgaccaaggtgtgatttactgtgtgtgtcccttttccacttgtgcaggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagtgagtacccaggcaacagggacaagcggcaggagtgatttagtgatgtcctttgtgatggtggtggtggcggtggttgtcatctgtattctgcccctggcctttcttcattgctgttcttaattgggctacgggtttgactagtctagtagagacccaaaataatagtgattagatgcaccgtatgatggtatgccctctgggccatgtgtttgacggta

SEQ ID NO: 17081 - DNA, 1153 bp, Homo sapiens
cccctgtgctctgccctgttgccatgttttgttttgccttcaggtttcagccagtttcaggtgttaccttttcaatgaagtcctttctcaaggccatccctccttatctccagctgctttgagtgcttccttctctaggctcccacagtgccctttatggaccgctattggcaatttttaatttttatgaacacatgtctctagagtactgtatatacttggaaggataccatgtcttgtctttgtgctagagtccagcgtagttctgaatacgggtttagtaagtgtttattggatgaataaaaatgggaggattcaagactggatgataaaagactgctcttgcagctctacctgcttatttggggagatggtacatacgtgcagttgagctccagacctagcatgactagcctatacagggctgtaaatcattcagccagcaaacacagtggatttccaatggagaacttttgctcttctcccctggcagattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggtaaggcctccccactccacatctgcctcatagggcttccttgccttccttcatctggccttattgagggcagcctcttagctcagccatagtcttaggttttgggtctctgtggtgggattaggctgggcagagctttgggagaaaggagcaggagattcagcctttgcttctgtcctctaagagctcccagaccacctggagaggtaagcatcataattagactatatgtggtgacatataaacagaggctaaattgtgtgttagaaactctgagatatagaagttcagaggagaggaaaatagctaagggtaataatcagggaaaatgtcagaaatgagacttgaaggataggaatattaagaaaaaaatgttctttcaatttctgagtttttgttttgtttttttttttcttttttagaaagtttgaggccgggcgcggtggctcacgcctgtaatcctagcactttgggaggctgaggtgggcggatcgtttgagc

SEQ ID NO: 17082 - DNA, 1169 bp, Homo sapiens
atactgagtttccctcattacataactcatttattcatttctttacctcccttctcttacccaaacttttccacctttcaaagggacgttaggattggccactgtgctgatctggagtgcacacagcaagctagtctgcaattgcctcctcctcagtccatacagtctcattcagatagggtagggttgcatgggtacagaactagtgggctgtcttttttgtttgttttgagacagggtctcattatgttgcccaggctggtcttgaactcctgggcttaagctgtcctcccattgcaacctcccaagtagctaggattacaaacacacactaccatgcttggtattgggttatcttaaccactaggcaatacagttgcattcacttcctgatatagattctagtctgtccccctttccatactgggaattaggattcctgagccagcttccaaaagcttcatacttcagttttcccttcctactttactcagtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaggcttgttggggattgggtcaggccagtgttcaagggcccctcctctagtactccctgtttgtgttctgccactgactgagcttctccccacaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaaggtgtggattcccttgcccaggctggagctggacaggctcagtactggagattcatttgttcagcttctccccctcttctctcttccccctgctgtgtgtagacagtggcactggatggaaccctattccagaagtcaggagtgatctctggtggggccagtgacctgaaggccaaggcacggcgctgggatgagaaagcagtagacaagtt

SEQ ID NO: 17083 - DNA, 1610 bp, Homo sapiens
tggaggtgatgtttgagatgagatgtgctagacacagtgggggctggggagacactgtcaggtaaacagcaccacaagagagcatggtgtattccagggccagcgtgactggagcaaggaggagttgcagggagcaaaagtctaaagagctcagcagaggtccgattaccagtgactctgaaaaccaccttcaagtttgcactttagcctatgggcgagtgaggccagggtgtttaaggaggagtgacagggtcagatttttggttttggtgcctgatggccagtttgggagccagataaagggggacatactgggctgagacaagattgggagtcatcaagaagcagggagttggtttcttcagggaggggaggggctggtgggcaccatgggaacacacagatttggttatctgtcatccctcaccacaaactgatctttcttctttccttagttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactcc

SEQ ID NO: 17084 - DNA, 1153 bp, Homo sapiens
cagcctggccaacatggtgaaaccccgtctctactaaaataaaaaattagccaagtgtggcagcgtgcgcctgtagtcccagctactcgggagactgagacagaagaattgcttgaacccgggaggtggagtttgcagtgagctgagatcgcaccactcttctccagcctgggcaacagagtgagactccatctcaaaaaaaaaaaacaaacccagcttaacttcactggacacagtggctcacatttgtaatcctagcactttgggaggctgaggcaggaggatagcttgagcccagggggttgagactagcctgggcagaattaaccagttgtggtggtgcatgcctgtagtcccagctaacagtggtagatgggagccagatgggggatctctgacctctacggttgtgtgagtttagaagtcatttggctttttggttatctcaccaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcaggtgagctgctgctggcatccctcctcatatggtcctcttaccctaggcaacgctagtttgtgtgataccaaataaaccagtagtactcttagaggaagttgcatgtagaagacagtctacctatatctaactctttgttctcctgaagcatagcagacttctcttggccgtcttatgaatgaaaggagctaaagctcatcccacagaagggacttgcctcagataccaagtccagtcctgtttcctagattccatcccccccaccctgcttctaggagctttctacctaacactggcttcatgggtcccttcctacagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatggtaaaaggaa

SEQ ID NO: 17085 - DNA, 1071 bp, Homo sapiens
acctttagagaatttggactctgggcttatccctctctaataccacttttctcccctccccacttcacctaagcaaggcctcatttatttctctgatacctttcctattggtgttttctggaatatctgttaaccttgactattttgggacatctcctctgtcagtggtgcttttgtttgctcccagatctccaccccatttctgggctgtcctggcactctctgtttacctcttcatctgacactgcactccccagacactgcttcacagtctctcactcacacaaatgactggatgtatcctgggttttctgcacagctcttttctgcttctgctttcttatgcaggtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcaggtgaggatgaggcatagtcctgggactgtcttcagtcctgggggtctggtctttttgtgtcccatccttgtgctccttcttcccccccactcgcaaaccatgaccctgtataattgtgtttttctagatatacagatatggagagtgaagattaccacttctaccaaggtctggtttatctgctggaaaatgatgtctccacactaggctatgacctcaccttcagcactgaggtaggtcaggaaatcctaatcacagcacatcccagccaatctggaagatccattccaggttcaccttagaactagcactgcgtgaccttctcatagttctaaggaagcatcttgacttcttaaagctgtagcaggtgtttgtgagtgacatcacaaacaggaaaaccagaatttgcaggccatttcctagtttcacctttat

SEQ ID NO: 17086 - DNA, 1138 bp, Homo sapiens
ggccatcatacctaaatactcctgggcttctccaccccatctgcatttttcatcagcaaaacagagtcacatgatttttgaaccacacagtttctaaagttctgttccatccgttgggggtagtacaggaggcacaggtggccatagaacacacacagcagggttccaggggcttccacaacactcctggagtcatccctatgcctctccttctcctcgtgcatgtatacatgcttacctgcttgtggcagaaatcacatgtcacaatctttgtgggcccttactcagtggaggtaagaaaaatttagagttggtaatgagtgatctacctctcccaactactgggcatttcccaaacaggtgtggagcagagatcaaagtgtttggaggatagaaggagcatcattgtgggtcttcttcctaatcacacaaacaaatttgttctgccacccttaatcctatcttccttccttttctacctcccaagatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtaagggcccaggaacggagaaaagatggcgggtgggaggtggggcctcctgcacagtagcgatggcttgctctagcctcaaatttagggaggtgctgccctccctaataggaattccccataggaatctggttttagataatcttactgagttgtctcctatcttctgggcctgccctgctggctggccctttagctaagctacccaacaattcccagacagacaggaaagtctttggtgtttataaggatatacctgctggctttgcaatgagagctttaatattgctatactaggaatgaccatgtatgagtggcctccaccaaactggtaactgctcactggtgattctgaagccacctagaggagatcagcagtttgtaatactgagcgtaggagctgatgagatgaaagacctattggagttgtttaatgattcctccccatctcttgtggtgtgggctctccaactgtgtaatcacaagaagtcagggagtctccctagacag

SEQ ID NO: 17087 - DNA, 1239 bp, Homo sapiens
tcttttaatagttggtgtctttcactttatagacaaggggaatctttataactggttagctatcccatttttctttggcttcaaggaagttcctctgtgacttgattctaccatatttccctgcaagttctcattgtttcttttttttttttttttttttttttaaatcagaaatgaggtctcactatgttgcccagactgatctcaaactgctgggctcaagcaattttcccacctcggcctcccaaagtgctgggatcataggtgtgagccaccacacctagcctagttttcactatttcttcttccttatttatttttataatttgtttatgatggcaaagaggtttgcatgttgaagtttgcagagtaaaatgttacttctccatcattcctaaccctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcaggtacagggaacttttaggctgccaggtgtagaaggcttcattttaaacaggattgtttcatacagttaatccttagttgatgagagagagagagagagagagagagagagtgtgtgtgtgtgtgtgtgtgtgtgtgtacatacacacacccgtgcacgtaaaccctgcatggtttcccttggcctcaggatactcaggtttagaatagaaatgctcagattcacgttcacacctcaagggctggcccttggttttgactagtccttttagagccctgaaataaggaagaggaaggaagagagagttgctagctggttggctgtcttacagcttctggggcagatgatgtgcttaattcctgctgtcacttctcccctcagagactcaccgcactgtgttaaaccagatcctacggcagtccacgacccaccttgctgatgggccttttgctgtcctggtagactacattcgtgtcctcgactttgatgtcaagcgcaagtatgtgtcctggatattggggggtagaggggtggtgagaactccccaaatggtaactcgcctctgaagttactcttgaggccacaaattt

SEQ ID NO: 17088 - DNA, 1164 bp, Homo sapiens
acctgagattcagaacattttattcattttgtcttatgattagaaagtgatggagctggacctagaatttagtgttctttcaataataagcattgctgccatctatcaaaggcctgccttgtgccaggcactgtgcaaaatacatcatgtcgtttaatctccaacaactttgcaaggaagtgtagttatctccattttataagtgcgagactaaagctcaggaaaagtttgctcgtgagtctgtattgctacaaagccctcattcatttctctaggctgctttactgtctgttggataaaactcttatatgacatatcccccaatatttaccaaaattgtctgaaggagtctgggaaccagttgtcttttccctatcaggaaggctcatcctctgtgaagacgtcctagaccaagccttgtcctccttttcccggcaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaagtaagtgtggatgtagactgggagctgtggggtatatactgtggcacccacttcacccccttttccatccagatagttctccctcagtgatagcaatcagcttggtttgtgtttgtgagaacaga

SEQ ID NO: 17089 - DNA, 1214 bp, Homo sapiens
acatggcaaacccaatctctactaaaaatacaaaaagtagtcgggtgtggtggcgcgcactagtaatcccagctactcgggaggctgaggcacgagaatcacttgaatcctagggggtggaggttgcagtgagccggtatcacgccactgcactccagcctgggtgacagagcgagactccatctcaacaaaaagctggtgggggtggggggcttcattctctaagctgtacagcagccctgaaaggatgatgtacagtcattgtaaagtgcctggtacatagtagacacctaagagggcagctgttactatgaagagcccttggactggacacccacctttctcaagcctccttggagatacctagctcattcccctcccccattcttatgcctaatcccagagctctagccactgaagtgttacccaaaaaccatgttctgtttccaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtgagggtttcaaacccaactcctggggatggaagaagggtggcagcaagagcctgggtgaaagttgaacactaagcaggctagcgtgtctttttgctcttattttaagtgttgagccctgtattgtttctaggggattgtcctatatatttctggggttttttcttcattcttttccatttttatgtatgtcttatttagtcatcaaaacaactgg

SEQ ID NO: 17090 - DNA, 1159 bp, Homo sapiens
ggaagactcgagcccaggagctcaacactgcagtgaggcaagggttgcaccactacactccagcctgggcaacagaccaagaccccgtctcaagcaattaataaggcgtgaatccctttacatgttatatctcccttcaggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtatgtgagcgggaaggtggtggggccaggctgcctggcaggagaaatgccctcattgactttttctgctccataggtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccgggtacagagggaggcaagtgggagggctctggaaagctttagccagatgaggctatgttttcttacctttgtattacctatatccagtttacaccctctccacaatctcagttttctttttctttccttccagctttcaccagtcgcttaagtggcaaccgtggggtccagtatactcgccttgctgtgcagagaggtggcaccttccagatggggggtagcagcagccataacaggtacctttgtctatttttaccttaccatatcaccactcaagtctattagcccagctcccttagttttataggtggagaagctgaaatcctgacaggcaggatggatggtctctctaagccatttccttgaataagtgagagagccagatctttggactccccattcagaaaactacaccttttggttagtcttgctaccaaaga

SEQ ID NO: 17091 - DNA, 1053 bp, Homo sapiens
cccagctcctcaggaggctgaggcagagaattgcttgaacccaggaggcggagattgcagtgagccgagattgtgccactgtactccagcctgggcaacagagtgagactccatccccctgccaaaaaaaaatcccttacctggtttgcctagggaagatgtttcacaggcatgcctggaacacagtaaatgttcaagaattgatagaaagggcttcagctgaaccttagaaatctcaaagtgagattgagagggggacagcaagggagaagtgagaagtctgagctgagatgcccctaaggaagcagccctatcaaagaccttatctgtcattttgccccggttccagatagaaacctaacctctccctgcaacttcttcctagcctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacaggtaagcatgtgtgggcaaaagaagggtaggatatattggagggtctttcaaagcacatttcatactcgtcaactaatggacatgcttgttatgctggggagataaagctggtttctgtgagaaaggggtattgtagcagtgttttataaacgagaagacataatacagacagcaacctgagcatgatttccctcagctccccacctgcatcctctgagagctcttccaccagagattctgccgtggccatttctggagcagattcccgaggaatcctagaagagccgttgccttcaacaagcagtgaagaagaagatccccttgcgggtgagttccgtgtatgcccaggtcatcctgggattgttttggcttctagtagcccttggcatggaaatgcccaccagccaaacag

SEQ ID NO: 17092 - DNA, 1141 bp, Homo sapiens
ttctgtgtacctataggtcagagacatttagcctcaccctatatggcctgaaatcttcccccttccacctgcagggcacagaaaggattttattcttagaatccacagagtcagagctccagttcttgcattcttgggacagagatagcactgtgccttaaccttcatccttagtataccagaccagagatgttccttggagtatttttgttgtggggatgatcactggctgggtgggatacttatcaggccacatttgctgattggggtggctcccctcatcattggctggttgccccttaaccactattattgttctttccgagaaagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataagtgagtagaatttcaacatttggggaggatgaaacaagagggaagaaaggatgtctttgtagcttctctttgctcttttgcttgagagaaatagtaggagttcaacttctcaaataataagatctcgtcttgcgcattcactttcttaagtgaagttgaggtcctgaactggtgatagttgaatgtctaatgatattggtgatgataccaacagttcattgaggcaattactctgtttctgggctatcaccccaggcttattatttaaaaacaactctccagctgggtatgatgactcataatcccagcactttgggaggctgaggcagggggatcatttgagctcaggagtttgagaccagcctgggcaacatagaccccatctctattggggggaaaaaaaaactctccaaaatcgatggtgttatttacatgagtaaactgaaactcagaaatgaaataattagcccaagtcactctgtaagtggttgaactagaattaaaacccagatctgtctgactt

SEQ ID NO: 17093 - DNA, 1915 bp, Homo sapiens
aggcattacattgcactatagtaagagagcacagaggtaaagagttacctaacccaatctgtggaagtcaggcttcacagagaaagtgacatcttaggccaagaagagaagagcaggtaaagaagcgggagaggagtcttcaaggtgaagggagcagcatgtatctgaggggcctagaagcatcactgtgactgtagtgtggaaaatggattgggagaaggtactatttaggaggccgttgcagtatctaagtgagagatgatggcataagctatggtagtgtcagtgattgtagatgagttgtgggaatgagggagaaaggacaaagctcaggtttccgtgtgaggaagtaaggcccaggagacatgattctgcttgaacaaacatggaagaaatttctttttgacactgacccttttacatattgtccttgcagcagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggtgagttacagagatctgttggattcatcggagctcttgtaagaattttcactgtgctttagcattgtcttaaccttgggggaaatagtccatcacttaatgttcttgtcatacacacaaataaggtatttgttccatttctttgtggattacatgtgtagccttttggggagtgcagccttttggggaataccaaattatgtcaatagttctgcgcatgtatttagcaattattaagtgtctcatgccaagcacttaacactttagatatagacgggacaagatccctgccctcaggcttagagtttagtgagacaaacaatcttaagaagtaaaagaaaggcatataagtgttgtaatggttggtgtacagacgacagagagggtgtagtggaggcaatgtgacctgacgcagtgcctggcacgtgggagcttattgacacccacttggtgccaggaactatggaataatatacaacttaagtacaaaaccagggtggtattcagaaaaataacttagacttgtgtgcacatcatcaggtttataatcatgttctgcatttaatagaggatgcatgaagaggatctcatggtaacaggttgcagggcacctctggacttaacagtgatcatggtacccaccattaccctacaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggcaagtttgtgtggtgaaagggagggtagaatttgtcagattctactttttccctgctgaggaaaagcaagacagtgtctgccctatagaaaacccccattttataggagccagaaccactcagtgacttagccatgggcaacaaaaactttattgtctctaggtacttgttatgttctaaacattgtgatagaccttgggtccttttagggaaatactgcaatttttggatcggtggatcagttaatgcttgacaaggccaagaatctcattcccctttgctgtccctacaggaaccctgtccagcatccccacagccctgacccgctggacagaagaatgcaaagttctcgatgctgagagcatgcatgactgtgtttcaggtgcgtggcagcttggttatcagggcaatagtg

SEQ ID NO: 17094 - DNA, 1391 bp, Homo sapiens
atccactttatcctcagccagtttttcaaataacatgttactactgcttgcccaaagtttgtcacttcttacttggttcgctttcttctcacccacctgctatcatcgctccaggttccctcttgccaacaggatatagtcaatagcaaagtagggctgaaaaggcaagggggcaccagcagacttggccaagtcctagaccatggctcctcaagcaccaccctctagccagcctccacattcagccaccctgctcagtgtgttgatgcattgattggcactctcaggaaatcgggtctggctcactaagtctgtacatcaccccagatctggttcttcctctcatagagtcagatatcccatcaccttcccactcagcctgctggcctgcacagtagcctgttttctagctactcagtttagtcctccaatgtgctccctttgttttagattccatgaatatcctggaccctgaggatgaggaggagcacactcaggaagaggacagcagtggcagtaacgaggatgaggatgatagtcaggatgaagaggaggaggaggaggaagatgaggaagatgatcaggtgaggggggactgcgtttgggttggttcagatgacctcttccatgggaacatagagctgcagaaaaccaacagtctgggttgctagcctcagcgtctccctccctcatgtgcacatgtggccatggcaccaggcttcagaaaacccttacctccagcaattctccatctcctattttcccttaaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctagtaagatacaggggctcagctgggtttttctctcttgattcttatacccttctctagggtaagccaagcagtggaccaaaccgatccgatacagacagcacttcttttcctatgctgacttcctggggcaagggatatctgaatccatctgtctcattagtgtatacttaggagaaggaatagtgagaggctgcttttgttcccttcacctcagtaaataggcagccattttagagcctggacaacttgatgatttgcttgattaaaaaaaagaaagagaccaaggctgactgcatcaggcacccatgtgcacaccacagtggcagggcaatcaataatccttatgtccataacacaagatcttgagggtttgaatggtcacctttgagcttggctttggggagcagatttgaacatactcactctattcatccaggatgcgtcttttcggg

SEQ ID NO: 17095 - DNA, 2484 bp, Homo sapiens
actccagcctgggtgacacagcgagaccctgtctccaaaaaaaaaaaaggaaaacttttatcatgttccttcctttgagcttttagggtttggggactaaatgctggtggtttaaaaaaaaaaatcctgagtacatccgagaagtggcttgcttgcatgtggtcatccagaatacattctgatttccagtcaagaatttgttactcatgtgctttccatggccccatgaaatatggcattgatttaactcttgcttttagggtgggttccttgaagacatttaagtcaaaattttttttttctaaacaaaagtagagtgttagttgtacgaccttatgccccttttctcttagtagattccattgtaagaagcttagtgtcatttagaagatagacacctagtatttctgtgctcagtccatctctttatcttcccttatctcagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggtagggaatcagagccaatggactggagaggtgggagtagttgctttatgggcctgggatcacaactgttctggcttggtggtgtttccctgggaacttgctggccttccagagatctgtcatagtggcgtgggaatctgccccacaaagaattccttcaaaatgcagccttgtttggctatcctcacacgtagccttgtcttttcctttgtcacccattcgtttattctctgagaacttacaaacttgcccaaggaagggaccttattgtctttgcgcttgcctcatggtgcccagcacataggcactctttgattattttgctggttggttgattgtttcaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggtagggaggcagatcacccagcatttccctgttgcggcgctgaaccaaacccttgccaggtggtgtgggtgggtgagtactttagatccttgcctcaatgctggctgctttgcagaggagcatgggtgatatgcttagtagatgctcagtaaatgtgtttgtactgtattaaaagaggggtgggggcagggccaggatgccatgtactatgaaatgatatagatcccaaccagaaaacttaggcacaggtgaaatgttgaagtagaaagctgacctgagaccgttgggccccgggtctttgatttactttggctctggtcattattggaagctccttaacaccaccttatgcctatagcaccagctcttgctggggcattaaaacagcagtcttctaaagaccctaaaggaaagcattgtaatttctggagctggtagcattgggtaagaaattgggcctgtggtcctaagctgctggctttaaagagatctattatgtcttcctggacagtataaagacaacccagtatcagataactgggatggacccatttgaaggatagtctggttgtggattggtagcacgtggtagtttctgtgctaattagcaccgaatgtgtggtttcacgtaacatcctctgtcacatgttatcctagaaatgtatgctgctttgctggccttttttagggtttcggtgctagcacaatgatagacttgtgtgcatccatatatatgttctatttctctccaggttgagaatgagctggaggacctgatagatgagttgcttgagagggatggcggatctgggaacagtacaattataggtgagagccccagaactgagtatagcctcttcctttgcctcagtctctcttgggaggaccctttttctcatcatctgcttgctcagctctgcctaagggctcatagccagcctagatcgctgcttgtcttgatgttgacggtcttacagatgagaaattcacaagacgtctacaggcctgtggcagtctaaagtgttgcctgtgtgggggaggtggtgggagtggccattgatacagatgatacatcaagcacatcaaaagagtgtttattcatggaggcctagaggaggctgtagggtgagaaagcgctgcctttcagttcttcaatgaagtccaggggctttctgcccctgagtctcagtagtgtaaaaagaatgatcattccctgagggtggccctttataaatctcagagggaaaatggcaaaggtaccctactgtcacctggctctgagggtgtatgtgttacttgtttttactttgttgatcaaggaaatcaaaggataaatggaagtagacacgtattcttaagttttacaaagcttt

SEQ ID NO: 17096 - DNA, 1223 bp, Homo sapiens
gttccctgtacttaaagtactttgtccagtgactgagacctgcaagagttataatgcaggataactgccagaatgaaggcatacttggataagatataatggacatgtaaagtatctcacagtatgtctagatgagacaggaaagcatttatggaggaggtcagcatttgagctgaactagataaaagtgtgccaggcagacggaagaaagaagtaagggagcaagacaagtttgaagaactgttagtagagtgtttctggagtatgtaaaaggagggaaatggagggagatgcacaaatagttggacaaagcatccctgttgtactgtaaccacataaatctgagacctgagttatcctggttctctgctcttgcactgcagtgtcacgagagcattcagtttgtacaggtggcttaaagtggaggagaaatagcattcttttccacctaagacttgattttgccagtgttccagtgtggaattgaaccagtgtttgacttttctcaacagcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggtaatatttccaacttctatttaagatgttacactgtacttccatcatttgggtaccgcctgtgtcagacactgctgggaagctgtgcatgctaagtgctaacccaagtaatgagtgagaagaggcatcttcagacatgcaaggccgggtgcggtggctcacgcctgtaatcccagcactttgggaggctgaagcaggcggatcacctgaggttaggagttcgagatcagcctggccaacatggcaaaaccccatctctactcaaaatacaaaaagaaattagccaggcgtggtggcgggcacctgtaattccagctattcgggaggctgaggcaagggaatcacttgaacccaggaggcagagattgcgggaatcacttgaacccaggaggcagagattgcgggaatcacttgaacccaggaggcaaagattgcagtgagccaagatcgcaccatcgtacacctgcctgggtgataagagcaaaactctgtctca

SEQ ID NO: 17097 - DNA, 1106 bp, Homo sapiens
tgagaagagcagaagcatagctatatgtaagccctgtgttatcaaggcaaacaatatataaatagttcagtatctccagtggctatcattatctcagactgatggttgactttgaggcataaagaaaatatttaattgtgttcctgtacactaagtggattacagtgttacatgtttttgaaccattctggtttaaaattgtgacagcatttggagaggctcaggagctgacattttaatgtggaagttatgtggggtttatagtcttgacacatctcccagtttctataaagatcacatgcagtctggtctaataattgatagttttgagacatgctgcaacttttttataagccaggttttttgaatcaagaagggatgggacgggacttaaaaataaaatgtcattctccccaaaatcaaaagcttttagtcttggtaactcttgactgcagttgtatttttagaaagtagtgtttaatcgacagtgtttctttctctctttactaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactggtaagtttcgcttgctcctggcctttgatattaagtttgtggcctggtataaatccagaaatttatttatgaggaggtctgtaacttgaagagcctccttaggcaagtattaggacatttgctggctaattgattgtttgggtcaatttattaggtacttcagtagcttctctgggccttgccctgttgtaatccctgccagagacactgaggactcattcattctagtccttcacttcaaagagctcattttggtggggcagtaggctttacatatagttaatggtttacaaatcaagtgataattaagggttaaatggatgtatgtctcgtgtaacacagtgcgaaatagacgtcatctgtgtattcctgccaagaaatgtttgacctgtatttaatt

SEQ ID NO: 17098 - DNA, 1659 bp, Homo sapiens
gttagtgtagtttatgtgtggcccaagacaattcttcttccagtgtggtccagggaagccaaaagattggacacccctactgtaaactttatcaaaaagaggggtatgtgttttggttttcttctttctgaaccagcattcctaacgtgttaggaggaggagagttaccattacctaattaagtatagatttcagaaaatcgagtcttcctaaggtcattgattagaccttgggtctgtagcaatttgatactatccctcttagaaatgattttaagtgtttagtcaagggctagggagtggttagggatggtatttgctctgttggaaggtctacagttcattataaggccttgtgtatgccacttgccttctggggactttcaggttttttctctgtaaatgataaaggtgggataaattgccagagttccttcctgttgtagcattttacctgggagatgtccctcccctcccccacctttataattcatttttggtagaggtttttttaatgtctgtttgaattcctaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatggtatgtaccaagagtgttttacctaaagctaatgtgcctttgtggcttaaggtctggccaatttcattgtgagttattttcatcagcttgattaacagattaaagatacgtaggcctcccttatgctttttcatctgatcttaaaattggtatttggcatgcttctcttaataggacccaagtgcttggccaattacttaggagggaggcgtgggaggaaataaacatcaagttaaactgtctaaaactgttattttcccattttatagatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggtgagtgtgttttgtatcagattctggtttagctttacatcatacctatgttctccttggtctgagaacaaatagacttctggttcttcttagggtatatagctagatatgtatactgtatactccacccaacagaattttccaactctatgcttgggagcttgcttaggtatggtaggatgatcctattgctagaaagtcctctccagcaatctggttttcttttttttctttttttctttttttttttttaatctaggtttcattaaccaagccaaaaaccgttagtaaagaactgggataccttcccccaagttcataccttcagaatcattcct

SEQ ID NO: 17099 - DNA, 2027 bp, Homo sapiens
gcccgccaccacgtccagctaatttttgtatatttagtagagacgaggtttcactgtgttagccaggatggtctcgatctcctgacttcgtgatccacccgcctcagcctcccaaagtgctgggattacaggcgtgagccaccgcgcccagctggtttaggtttttaagactctaaaaagtaacggaggagaggcggaacaaaagaaaaaaatagtatagctgaaaactgttggacagattagacgtaatagctctaagaagagggacgtgtagggccaatatagagattggggaccttttagatgtaaaccccccttgccagggtaaaatactaatattctgtctacttttccttatttgaatttagaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagtgagtattcagtattctaaaatcaaaaggaatttctcatgctaagtcgttcccactctattttgtcctgcttaatgaaataacatgcttatttaagaaccactggatccaactcccagatagggctgccttacgtaagggaatatagaccatttgagaattttccgtgataaacatttgagctgtaaatttcagattggtacttgcattaggccgttcttgcattgctataaagaaatacctgagactgggtaatttataaagaaaagatatttaagtggcccacagttctgcaagctttggaagcatggtgctagcatctgctgggcttctagggaggcctcaggaagttcacagtcatggcggaaggttaagtgggagcttgcatgtcacatggcaggagccaggaggtggagggggtggtacacactaactcactatcatgaagacaacactaaacaatgagggatccacccccatgacccaaacacctccagcattggggattacaattcagcatgagatttgggcagagcaaatattccaaactgtatcactgcttaaggttgagtaaaatgcctcttctctgtgcctccttagacctcctcatgttggccaattattttgttgctggtactagttgtggaaggactgttccataggtctttaacttaatccttctgagctttgaattgaagcaaaatgattttcacacacttttcaaattacttacaggcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacaggtagggtactggcctcacactccagggtccagactttgcacccaatggagtgtgatgcttacggattttctaagctcacataccactgagtccctggtcacattaaccaggagacagtttagatttcctccttctcttagtatttattttttttctcctgaggaaaactggagtatagtcctgatgctctgcacaggtaatactcctttcaagcatgttgatgagtattctcagtagcctcctgctgcctcagtggaggcaaactgtcctcagttactttctggttaacctgtaaagagaatggatattgtgaaccagatttattctccaacaagagctttctgaaaccttagtcacctacaaaacttttgttttcacttgcaaataaaatgtataaggggcattttaaaaattgggaggccagaaagaggagaggggaaaggcatgtaaagtcc

SEQ ID NO: 17100 - DNA, 1181 bp, Homo sapiens
gctattgagcaggagtgtgttctctgttaattgtgaatcaatcaaatctgaagtttaaaaaagcacaagtataaaggatttagaaaattaaattacttaacaaagcttagggattgatttttatgacttctttattaaatgaaataaaatgaaaatgaaacattcaaggaattaaataaatctaggtacttactgaagtaaagaaattgaatggaaataataatacccctaccaaataatttagaaagtagttaatgaacctgtaaaaccatttctttgattcagaaaaaaagagtagcctctgatgcctttctttcactttataaaaaacaatgagaacggatgttgtggaaatagtttgtaaatattgtaagaggataccttgtggaactgtcgtcttgagtgtggacattttgatgaggtggataactctgagaatagcaatgaagaaaaatcccttacccttataaaactgttgaaggtcaatttttttttttaagtataattgttcagagaacatcccaaaggtgaaattcttgttatgattgcagagtgaaattcgttccatctccgtaaaccagtggggctctcaattgggtctgagtgttttgagcaagctgagccagttatactgttccctggtgtgggaaagcactgtcctcctctctctgtgtaccccaaacaggtaagagaatggctctctctcttattactttgttatctaagttcggtgagcctggaggattgctttggttggggataggagggtatggaagagagttcagaggcctccttgtccttccctcttcccagcctaggaacttgatgacaaatgctttgtcgtcatggtagatgtttaaaatgtgttcctgttattagccagatacaaaaaattgagttgtggctggacacggtggctcacgcctgtaatctcagcactttgggaggccaaggtaggcaaatcaagaggtcaggtgttcgagaccagcctggccaacatggtgaaaccccatctctactaaaaatacaaaaaattagctgggcgtaatggcgggcgcctgtaatcccagctatttgggaggctgaggcaggagaattgcttgaaccccggaggtggaggttgcagtgagcccaagatcatgccactgcactccagcccaggcgaaagagtgagactgggt

SEQ ID NO: 17101 - DNA, 1165 bp, Homo sapiens
tccagagttcagtgtttcatttgcattatgcgtttcatttgcattataagcacatttgggggaaattttccatgatgtttgcctgcaggagagaggtaggcaaggagcactaaatagcaaattaagagattaaacatgattgtaccactaattcataatgtggccctgagcaagtcacttaacttctctgttatctcgaaatatctgattcttggtgtgcttgaaaatggagattgggcagaaattgtagatattctttacttcctggatgttttagaatccgtatcatacatctggtttatctgaggttttgatactctatagaaaacactaatatcatgactagaaggctaccccatccttattccaggctggccatttagttccacctgtcaggctctaacttctttaaaaaatttttattacctagatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattggtaagaagcatctggccaaatgttttcatttctttctggaaatcaattttgcgatacttctgtatatatgtttttactatggtctcccttcaactaaaaaataatgaataaatttgtgttatgttgtataagtgaattttgtgactaatatatagtgtgccatgttatttctcattgaaaagtcaaagtattttttctttgttcatcggttgggtatgtagttctacatcattagagtttattggagggaaaagtgtatctccaagaaagcttttctagttgggttttattagtacctctcccttctttgttataggtgcattttaaacacattttatgtttatggttatgtttaaccatgtattttcctcccctttcaagcttggtagtcatgtattttaagcataattgacatgtagttcattgccgatacttaattccccccttttcaagcccgatagtcatgtattttaagcataattgacatggtagttcattgctcatattttgccaaaaatgaagcttctttattttttcatagtggtaaactacacataa

SEQ ID NO: 17102 - DNA, 1065 bp, Homo sapiens
ggtatttgattccagataactttttttggaggatattttactctctcaaagattggttcttttcatactattctggcacctgttgttttacaaggcagtctttggtaaaggccatgccattttcaatagcttttagttgttttgtgtcacttttcctagatgtaagtgttgcttagctattttcataatgatttaccctttttttccccttttccagctttcgactctgtgcttaattccgtcttattacccctttctgactcttaagtgtttgtgttctttctttttttaacccatgttagaaagcctattgcatggacaaataataaaataggaggagacaactgggggccattagattagaattaacacaggctttgaggaccacagtgtgataatacataacatatcactcaattatccccactcctcacacctttccagactattcgtattctccataatgttcacttttcttttagtgatggatggttctctgcctacctccctgaaacacatcatcagcaatgcagaatactatggcccatcactcttcctcctaggtaagtggagttgatagttggttataacaatttgggataacctggcagagctctctctctctgtatttacttacttacttatttacttatttatttttgagacagagtctcactctattgcccaggctggaatgtagtggcgcaatcttggctcactacaacctctgcctcccgggttaaagcgagtctcctgcctcagcctcccgagtagctgggattagaggtgcctgccaccatgcctggctaatttttgtatttttagtagacaaatatgaatagtaaaatcctgcaaggatataaaacacagagaggccgggcatggaagctcctgcctgtaatcccagcactttgggaggccgaggcgggtagatcacctgaggtaatgagtttgagaccagcctggccaacatggcaaaaccccatctctactgtctacctggacagtagacaaatgtcaatagtaaaatcctgcaaggatataaaacagagaggccgggtagat

SEQ ID NO: 17103 - DNA, 1099 bp, Homo sapiens
actaccaactagtagtatatgaaattgcacattttacttaccactctccccctcttccccaatttggtaggtgagaaatattgaaggacttctgtaggattgttaatttacacacacacacacacacacacacacacacacacacgtgtatgtatgtacgtattaatacatgcaactagtgatatattttcattttggggttcagtattcctgatcttcatttttatattcatttcacattaatggaagaaattttctcaaacaaaatttttctttttgtggtaccttttattctagtaagtttctttatcataacttgtactttagttgcagatgtggctatggaaagcagtccaggctcatccatctctatggagcacaggctggatgttgaattaagggcatcaggttccagcagcagcactaacatctcttctggccccagccctggtcccagtcccggcaccggccccggccccggccccggccccggccccggccctggccccggccccggccccggtcctggtcccggccctggccccggccctggccctggcccccgtcctggtgcgtacacacatagatgtgcagtctttcagagtggtagagttattaaactattgaagaaggcggctttaggcagaacttaaatggtacatttggaggttagcatcccatgactattcatgctccttcaccattctggtgttccattttcttatattaacatgtctttcatagcattttatacttttccaacaatttgcacattgattatcaaaacagccatgttggagggcagataatatccaaaatgggaactgagtgaggtaaaaaaaaagttgaacctttttactttgtaatttttcttttttactttagacttttagtattggtaaaattaaaagtattagtaatttttccaatttcaaagcttaattaagtattcttcctaacattcagagacctcacttcgaatgtcttctaattttattatagtgtatttggatctcttaaaattttgttttatgtgcttgatcattgtggtttaatggcgaactcagcataattcttttgtctttcttcattgccagga

SEQ ID NO: 17104 - DNA, 1435 bp, Homo sapiens
aaacacgaaattcattgatgtttcgtatacacattatatacgtagtcttaaggcaattgtatacaatatttcaaataattttgtgcattttaactgtgacctgtcacatgagatcaggtgtggaattttccacttctggcatgcaggtattcccaaagttttggatttgggaatatttcagatttttgaatcagggatcctgcattaatgttctctgtatatcaggcttatacttgtttgccttttggtttttcccagagggttagaaagaactcccagtacttccctctttgggtattaaactgcaaaactaacaaatactagattttcattgttgctctcaacagacctccatcccctcaagcagttaccagtagaatgacttatattttaaagtttggatattagcaactggaacttggttcagtcatcttattatatttgacacattatgtgtttaccttctaatttaataggagattaaagcagcttctttacgaacattaacatcaattgtccacttggagagaactcccaaactcagcagtattattgactgtactggaactgcctcctaccatggatttttgccagtgcttgtaaggaactgtatccaggccatgattggtaagttttgatggtgattatcttaggcaagaagaaacatttgccctctgcctttgtctttttaatatcctgcctgcttaacagcaattttgagcttgtttttgttctccctctccccacctcccttgtagatccttccatggatccataccctcaccagtttgccactgctctcttctcttttttataccatctggccagctacgatgctggtggtgaagccttggtctcctgtggaatgatggaagccttattgaaggtgctgtactttttttttttttttttttaaactacatggggaaatcaactaagggtgtagagatgcaagtttggggtgtttcacagtgagggcaaataatataagaaagcttatccagaaaaagttatacttaagtagaaggccagtttggctttctagttatctaattaacaatgtttaagagcagctacttccattattgagacttttatcatagtgtagaatggtcaggaggtcatgggttctggttaaaacattgccacatgttatcatgcctttacacaaccatagggaaaatatatgtcagggtactttgtaagttgtgttgtagtagtaatagcctttactatgtgcagggcaatgagcaccagcttttttctccctaaatatcttacttaatcctgcaaagtaattgatgtccccattacctcagaggttgagtcgcagaagtcatagaactgtcatttggcaggcaccaaaaataaaacacatgttttcccccatactgtgctgccttactgaggccccagactacatgtatacaaaagc

SEQ ID NO: 17105 - DNA, 1165 bp, Homo sapiens
aatctgctttgtaactcagctcatgtcaaaaagagaggaactggaaagcatgatttcctccctagtgctttcctccctagtgcggaaggtgagtaggcagagcctcaggcaaggcctgataggacaggagggacctgtcagcacacgtgactacaggggtatggaatataatggctggcagttgctgcttgagttcttcctaggagcatcctcactgaacagtgaaattgatctcattgaagaaatcacctttaggcagaccatcttgccttgattcttaagttcttatttctgttcgttttttcctcttgtttgactttcacattggatgtcttctcaacattatgttccaagcagccacacactcttaaatatatatatgtatgtgtatatacatagagagaaagagagataaggtctcactctgttgcctaggctggagtgcagtggcgcaaagtcaccataagcactgtcttaacactatctttttcctttttcaagagctggggtggaaaggagaatggctttggacttgcagaatgttgcagagacttgcatatgatggtaagtaactctttgggatatgggtgtcttttgacagagctgtggcctctctgtgaaccttactttacaatgaattgtggtatatgaagtgacgccttcacatcgagacctttgaggaacctaagatcagttcagacatagctgaaccacgtctataggaagcagtctagcagtgcttgggctcttgatgtgctggtggtagataaaaaaatctgagaaatagagtgtgtgttcatacccagttcttgagtaggtagctgtatttgttgaattaattttaatgtgattttttttaaatcccagaaagtatgttcgcttgcattctcacactggaactattgtatcagaactctggacagtgtggtgtgatttaggaatggctgcttggagagcagttctaccattaggtttattgagaacttataatgttttatgtgctttccttgtttatctctctgcctttcacccatgtttaagttatgagctcaggccatcctcctttctgctttgatatgttgctgtggagctacaaaacacaatttgattttcaataattattttgcatctggaagcaactatattttccacgtgggatttgtct

SEQ ID NO: 17106 - DNA, 1261 bp, Homo sapiens
agagaacataaaatatctttctttcacaatacttttagtccagttagagacttaatgttcttcttgagtcccacatgtgtatttgtctcttttccttcctgtgggaaaacctgcgcaattttgaaccactatttacgttttttacttttattgcactttatagctaactgccagattttaagctccttggggataaggttgcatgttgtagattatcaaatacatatatatatatatatatatatatatatattttttttttttttttttctttttttgagacagagtctccctctgttgcccaggctggagtgcagtggcgtgatctcggctcactgcaagctccgcctcccgggttcacaccattctcctgcctcagcctcccgagtacaaatacttatatattttttgtattgttgtgactaaacttcttgatagctttgtaaatgttgacaagtacattttgttttgttttcaaggccagttgtgcctgataccttgagctttgcccttttttgtccctttagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagaggtgagtcttgggtgaagagttggaggggtgcaaaaattggagcatatggttcctttcaacaggtgtttcttggagtgttaaaatatattagaatccctaagttaacttcactggcctaattgagttagaactattggtgccctgttttaaaacctaagtattctcagttattaagtaattttgaaggaattctttaatctctgctcaccaaacaaaatctctctgttcaaaagtggcaatttcacttctgaaaggaaagttcaaaattagattcaattctgtgtgagaaggaagtataatgcaataataagatctagatttgagtcctggccctgcttactagcgccgacactggtttcctcttctgggaatttaacatatctacttcagggttgatttagaatgaaatgaattgtggggtactcagtgctgtgatcagtaagtcgtagtgattgtaattgaagccagaagctctcatataaaagttcagctctaccaaactattgtccagtgttcccagaggcaacttcttaatacatacttagctttgagaggtaacccactgttggaaagctttctta

SEQ ID NO: 17107 - DNA, 1136 bp, Homo sapiens
tcttttttttagccttgtgatggaacagtaggtctttttcagtcttttactattatacatggtcatgcagtatggattcttgtggttaaatatttgtgtacatctttacgactttctttggattaattcctagaaatggaagttatcaggaaactgcagggctatggtgaatttttccatcctgagatgtgttgcaaacattgtacactcttattttcaattaagagtttgagatgcttgtaaaagagaaaaaattttcattttgacctgatttggtttcagtcttgtgcaacatagggatgtgggccagtttgatctggagagattctttacctctctctacctgatagctgtgcctctgagttggcatagcatcataactccagtgtttttactttaagcattttgcattgctcttcattctgtattgtctgtgtccaagcttgtagagctcaagattgtagctttaagttctcacttcttttgggattttcttttttcagatcgtaaagctgaaaattgaaatcatgaaagtagacaggactaaactgaagaagacacctactgaggctgtaagtatccaaaagtttactttgcttattttttcttcattaaaaaataaaaaaatatttgtgaacagttcatccatgctcttcaaatctcatcacccatatatacaaaaggcagtaaaacaacaacttgtctagaaacagtaagattttcttttgaacttccctggatcaaaaaaatggatagccaagagaccagtggaaagtgaacaccgatcagttagttcttcgtagctgtgtgtgcctgaagtcagctctcaggctgctgtgcaattccttcctatgcagaaaggatgtgtggtataatggaaagagcagatatgggttcagatttttaatgtacttctgggatcttgcaattttgttttttagaaaatgaaagtggtaacatctttcttactagtttttttgttaaggccagtgttttagcttgtctttattactgattcttaatcacacaattcagcttaacttgtgtattgggtggtcatatcaattaaccctttgtcgacagtagaaatcccagctttaatctagtaatattccaccagctagcttgaactgctt

SEQ ID NO: 17108 - DNA, 2715 bp, Homo sapiens
ggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaattgctttgcttggcattctttttttttgtgatgagggtggtggtgtggtgcagggtctgggagtgctgccttctccttgtactctttgtctctccctcagcaagttgtcaggcatttccctggtgctcagccttatgcttgaagtgggaagggtattcccaccctcaggagggacacgcttcacacacctgaagtagatcatcagaagcagactgagcagaaaagaaagggtgcaataattcaaaggggcctaacaagttcaatgggagggctttccagagactgctttttcaagtgtgtcctctttctgtgaatgtgggattttttttttctttccctctctcttccatgcacttgttgtgcaatctggact

SEQ ID NO: 17109 - DNA, 1623 bp, Homo sapiens
tttgggctttgtgatattcttgcccaagaagtaccatttctacagaaatacaactgactaatcttctagcagggttctttttgaaaaaccccatgcaccttaacccacagcaggtccttggtgatttttgcccagacaaccagaaggctatttgcttactgcccacttacaatgaccagatcataggaaattgaaaacagtgtcagactatttagtcctaatctgtcccagattaagagaatccatgattttcagggggagggagccctgcaatgccttgacccctgcccagatacttcttacataaaccaaagaaaaatgacaagagtgtacatctaaccagacagaagtagaaacaaagtatagaaaaacctcctctttggaatcagctcccttaatgtggtcccccttctcttggacctgcccaacctttcacaacgtcttgaaggtaggacttctatatccagcaaaggaagggatagtagtaaatttacatggcttggaattttctttctggagccacagagggatgaatcctttggagctctaaaagcaaccagtatcactgagctgtgagatacctatatctccattttctaataggaagcacttggacttaaaattgctaagatattttttgcagttgctatttctgtgcatcttgaatctatctgacacaatcaaatgacagtattgttaactctcacaccattaagaaaatttcttattttgtaggcattcactgtgagaggtaaaattgctgctttggcaggtatgattccagtttgccaaacggcttttcttccttccacaacctctttttcccctagcccagggtgaaacaagtgggtcatctccaaccttgatttttatttggattcagcattttgggtttggaaggttacaagaaggaaccataaatggccatattcctagatttttatttatctgacaaaatacacaacttaaaagccaggaaaactaaggttcattacagggagatgaactttttctaattggaggacaaattgtggaaggtggggtctgatctttgcttcaccacttgaagagactgtcatccttcacctgaggttccatttctagcttttatgtgacctctcttgaacaaagtcatttgggaacccccagaaatgacccctttacattgtaggaccataagcaaaacactggttgtgtatagtcactgatccccaaggacttgcagttttttatttctgctggtgtgtcttgggatcagcttataactcctactcttacttagtcagtgaccagtccagtctggtctggaccaggcctgacaaacttctgctcacttgcatcattttcattctgagccagtaggactttgggtagactttaaagcccaagaattggtactcgctttggctagtgacatttgatttttgtctccatcttgatttctgacatcattggccaagtcacattaactttttttgatcactgagaaaaacagtcgaacaaggcattacagagggtggttaaggtagagggtggggggcaggaatgcttatgtaggatagaaagaatgtgggggtagctgtttggttatggtgatccagtcctttggaaccttacaaggct

SEQ ID NO: 17110 - DNA, 1145 bp, Homo sapiens
tcctatagaaaagctctagctttggtttttctgagcatttataatgatactcattatcaaagacttatatgataaacctatgaggttgtggggacagctgtggcctcctgaggtttttttttgttttttttttttctctatgaagtggtatctacctcttcttcactccttccaacttacctacccctggattttgtaccaccacctctagctttggcctgacaatcagataggtagatgttttcagaaaagtaaggtagtattggttattttaatttttattttttattttatacacttcaaaaaaactatcaatggcctttgtactgggggattcaagtgaatcagaaaagtactgggcagatttttcctgcctctcaaccagtgcattgtttgtaaaatagaagatgtggcacagttcattcactccctattgcccacaccatgaaagggtgggaatcagtgtaatgaacttgagtacgaaagggactcaagagactgtgtgtgtgtgtgtgtgtgtgtgtgtgtgtgtgtgtgtgtgaatgtgtgcttgtgtgtgggtgtgggtggatgttgtgtgggtgggtgtatatatgaatgtgtgtatatgcatacacataccctttatataaagagacagatctatttatctatacatattttatatatatgtaagtgtgtgtgtatgtgtgtatatatgtgtgtatatatatatacacacatatatacacacatacatacatacatacatacatacatacatacatggtgatgtcccagaggatttactcaatttcccagaaatgcttccactgctatggagtggaaggtttcaaaagaccacacttttaatctgaaattcttactaagtcacagtgcattcacaactatgagaagttggatgggcttctctaaatcagacaaaaagtactttccagaaattgcctgttcagaacaataaactcttgggttgttacaagcttaatcttgaacagagccctcacatcccatatggtgaaaacaggaggttggaatgggattgggaagagttgggcatttccttatgaaggtttggagagaaaaggggggatgggaggtgactaccatttgaaagggctttcagccaatttggaggaaatctcttc

SEQ ID NO: 17111 - DNA, 1942 bp, Homo sapiens
cactacctgtgaaacttgcttttttgccttgattctcagtattctttcagattataaatctggtctgcctcttttttcccagtgctagccaacagtttgagatgagagggatcatcactctcatctgtgtttaagtggagagccatgtgcttctgtgaaatatgctttggggatttgggggtggagagcagaagaataattgaaattggtggcaatataggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgagtatgttatcttattaaaatgctgccatagtcac

SEQ ID NO: 17112 - DNA, 2333 bp, Homo sapiens
ctggactcgcaaattaaaaagctgggcatacaggctacggcagtcaaccagctttttcaagagatcaaaagtccgtcaaggtagtgtgcttacagtcagggacatagactaggtaacatcacttttcatttacttattttttttgttgttcatatacaaatcttgccactttttccacatagcccatgtatgtgacatgtcccattaatgtcattgccattttattttttccttttgtaactaatttggttttccggttattcatttcatatagatactaagtcttgggataaatcttgcaatgtctgatttagacttagggacttaatacaatgttgcttattacattaacaccttttaattgtctagcaggagttaagctttttctacttttcttcatttttggtaatgtaaacaaatttagtcttaacaaacaattttctcttttttacttacaatttggcaaaacttgcagtggaaacagaagagatgagatcagcaattgctcctgatcccattcctctgacacgggagtccacagctgatactagggctttgaatagatgtaaagcgatgagtggatcatttcagcggggtcggttccaggtttgtgtctttgattgaatccttatctacaagggcattataaaatataacagccagtggagatcttggtctgtagatgatacttccatttttgtttttatttttttttgagatggagtttcactcttgttgcccagttggagtgcaatggtgtgatcttagctcactgcaacctccgtctccttggttcaagcgattttactgcctcagcctcccgagtagctgggattacaagtgcgcgccaccacacccggctaattttttgtatttttagtagaaacggggtttcaccatgttagccaggctggtcttgaactcctgacctcaggtgatccgcctgcctcggcctcccaaagtgctgggattacaagcatgagccaccatgcctggccgatgatacttactttaaatgtagatcattgtcatatttaatttgttcatcttgcatgcatcccctcaccttttgaagccatcagtaaagatgaatctaaagaaatggagattttcatagctggtagagagcacagaaataggttttcttttggcgggtgggtgggtcctcttttataaatgtaatttcacgtcctttagaatctcagcaactctaattgtggaattttatttgagcaatatgatgcccactctctttacccaaggggcctgattgaaagagtgaatttgggggtatagattaaatttttaagttttgctagtatcaatacatatacatcacagcagagcatctacttgtctgtgctatgctaaccacttttacgtttttatatctcaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaagtaaggactgtttctcttttgtcacaaatctggttgccctaggttttatagaacttagtattggattggtaactaatttaggattggtgacattttaatgattgaaaactacaaagaatgctaatgctaaacatttatgaatgagaaaaagttcttatatataaaatgttttcatagtctcaagactattacagttgcttatttaccaatatgatttaactactctttttgctaacctttacaatccttattcttcaggacttttggttttagattttacaactattcttatataatttcacatttgataagtaaacagctga

SEQ ID NO: 17113 - DNA, 1151 bp, Homo sapiens
gttacctaatcttgagcattacaaattacactctatcagtatggaaaattaaataaattatttcagtgctttatgtagatatagcaaatattcaacaaattgtatacttaaaaatttgcggccaggcatggtggcccacgcctgtaatcccagcactttgggagcctgaggcgggtggatcacgaggtcaggagttcgagaccagcctggccaacatggtgaaaccccgtctctactaaaaatacaaaaattagccaggcatggtggcaggcgcttgtaatcccagctacccgggaggctgaggcaggagaatcacttgaacccgggtggcagaggttgcagtgagctgagatggcaccactgcactccagcctgggcaacagagcaagactatgtctcaaaaaaaaaaaagaaatttgctttgggggagtagaaattaacacagataatccttataggaaaggggatgtgatcttggtggatacgtttttctcttctataagaatgtggtggtggtgttattttgtaggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtgtaggtataacttttttctttttactttatcagttgccacgtttcatgttgaaattagttaagtttgacttactcaaaactaattttggtttagctctaggtaacagtattaaaattaacaattgtaatgcaacaagccttagatttataccatatgactatgcttcattggagtcatataaaatgctctgtattagtatctttgggaaaatgtacaggtatatcatctatatatatttgtttgtaaggaatttttagttatctattagatggatcttatttttcaaagctgaataatagagaccgactacatggtttcttctaggtctaaaagcctttttatgaaagggcattcaaaatatagttcaatagatacagtatttgggtccctgctatgagtaaatttttgtgttagaaattgtaaggaatgcaaacatgagtaagaagtgtttgctaccctaaag

SEQ ID NO: 17114 - DNA, 1232 bp, Homo sapiens
attgacagatggagctgagaactaggtttctaaccaatattcatgcaatatgaagacagattgagctatatactaagtagtctgctagacactgaggactaatggtaaacaagataagacacagtccctagagtctgctggttcctaagattggacagaaaaaagaataaacttcttattaaggaaaaagggattaaaaaatcaggtgatttgttttctccttaatgatttcctttgtagggtgattttaaaatatctttttcccccccttcaggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggtaggtatataatcttcttggttataataaattcaagttttagctggcctggccttctgtgtgattcatgattatccatgtatcatggattaaaataaaataaagggcttgtcccccacatcctagaaattatggtcctttcctatatcctcttaggagctcactccaaacttttttttctcctgttgttttcttttctgttttaaaggggaagaaaaaaaaatctatcatggctttgtttttctttttcttttttctttttttttttttttgaggcggaatcttgatctgtcacccaggct

SEQ ID NO: 17115 - DNA, 1171 bp, Homo sapiens
aaagttacacagccaatcctggaaaagctggagcagagcctgggtctccagtggtcagtgtattcagctctcttttaaatctcccctccaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttttttttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgcttaatctgtggcttgacctgtgagtagtagccttagaatcagccttctgggagctcagcttcagagtttacaagggagcagtttctgggcccaccctagcagcctggtactttggacaaccaaacagatgaacgaacggagcacagcagtgctatgaaagttactgtaagcctgaaataaactgtatttttcttaaaaaaaa

SEQ ID NO: 17116 - DNA, 1284 bp, Homo sapiens
atggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaactttcatagcactgctgtgctccgttcgttcatctgtttggttgtccaaagtaccaggctgctagggtgggcccagaaactgctcccttgtaaactctgaagctgagctcccagaaggctgattctaaggctactactcacaggtcaagccacagattaagcagtaaggtattatttattaagatcttaagcctcacccctgaactcaaatgggatgggataaggagtaaggaaagaggttagaggagacagaaaacaaagcccagctcttccaagctcaccacctagccaaggtcttcgaattcctgagggaacccaggactggaggctgggctgaaggaaggcagcattcctgggaggttccaagttctgggcaggggtacagagctgttgcgtgtgtgtggggtggggtaagggagaggctccagagctactttcattcacattttcaactattctctcttccacttgcatgttca

SEQ ID NO: 17117 - DNA, 1213 bp, Homo sapiens
tttgcatatattaattcatttaattctcacatcagctctctttgctctccaagtcaatacattttcatctagagctgggattctaagccagacttcattaaccacccacatacccccttaaaaccacaatgctagattacctctcaatgagtgtaggaaatggatgtgatgaaagacagaaaaaagcatgaggcctaaatgtgtgaatggcttgaggaatgaatgctctgactgaagaaagaatgcctgagatccgcacactccttccactggcctgtagaggcagcagccgttgcccaaatgaggcagacgaacctagctttgaatctcagctctagctgattcactgggtggcactggacaaatcactcctgccacctgagcttgagcgtcttcatctgagataggaatagcagtccctacactgaggaggtattaaagctaggaggagccaggctaggccttctgtcaacattgatgcccggtgtctctggccacagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggtatgcatcctactccttcgggtcctttcagccacctggcaaagccagatccagtccttgacctctccttggccttggaagataaggtgagccttggaagataaggtgagcctatctctaagaggaaatcagaaccccaacccttgagagacaaagactggctagagacaaggagtggttgtggtatgtagggaaaaccaggatgagttgtgggcctggcttcctggaaggagtagagatggggaactgctaggtccaatttggagtgggtaagagtatgcagatgggaccgagcgcagtggctcacgcctgtaatcccagcactctgagaggccgaggcaggtggctcacctgagatcaggagttcaagaccagcctggccaacatggtgaaaccccgtctctactaaaaatacaaaaattagcctggcgtggtgacgtgtgcctgtagtcccagctactcaggaagctgaggcaggagaattgcttgaacctgggaggtagaggttgcagtgagccaagttcatgccactgcactccagcctgggcaacagggcaagactctgtctc

SEQ ID NO: 17118 - DNA, 1218 bp, Homo sapiens
aggtcaaggactggatctggctttgccaggtggctgaaaggacccgaaggagtaggatgcatacctgaggggctccgtagatatacagcaccaagggttcattttcagggaccacgaaccatgccttgtgccatcctttgccacccttctccatgtagtgcaggaagctgcagatgacgctgttctctgcagccactgaggcctgtttctgtggccagagacaccgggcatcaatgttgacagaaggcctagcctggctcctcctagctttaatacctcctcagtgtagggactgctattcctatctcagatgaagacgctcaagctcaggtggcaggagtgatttgtccagtgccacccagtgaatcagctagagctgagattcaaagctaggttcgtctgcctcatttgggcaacggctgctgcctctacaggccagtggaaggagtgtgcggatctcaggcattctttcttcagtcagagcattcattcctcaagccattcacacatttaggcctcatgcttttttctgtctttcatcacatccatttcctacactcattgagaggtaatctagcattgtggttttaagggggtatgtgggtggttaatgaagtctggcttagaatcccagctctagatgaaaatgtattgacttggagagcaaagagagctgatgtgagaattaaatgaattaatatatgcaaagtgcttagaatagttcctggcacagagtaagtactcttttaagtgttaaataaatacctagatttgtttttaaaaaaatctccaaaatgtgtgtttgtgcatatatgcctagaaagataggataagccctcacaatggtaacttttgggtagaagggatacggtattttattattttttgtttatattggtctacttatcctactttgtaataacaaaagacaatttttaaattttttttttttttttgagacggagttttgctgttgttgcccaggctggagtacaatggcgcgatcttggctcaccgcaacctctgcttcccaggttcaagcgatttgcctgcctcagccctcccaagtagctgggattgcaggcgtgcgccaccatgcctggctaattttgtgtttttagtagagatggggtttctccacattggtcaggctggtcctgaactcccgacctccggtgattcacccgcctcagcctcccaaagtgctgggattacagg

SEQ ID NO: 17119 - DNA, 1092 bp, Homo sapiens
cgaaagaaaaagtgcctggtacccattgaggtgctctggaaatgtgaagctccattcctgtctcttgggacctggaatggactgagacattctctcaaaaactctctaatgttgccttaggctttttcacaaccacttcaggtccacttctcgattttccttcttacccctatcggtgagtaaggtacccaagtcacagaaagctgatatttgccaaaaggatgtcagcagaggtggcctttgacccagttctcctgccctgttgaagactcttccagctcacaggagctgggtgtccaaaagtatagactgcctggattcaaatccgagctttgtttcctttttactgtgtgatgctaaacaaattacttcacttctttgtctcaatgatgtcatctgtaaaatggggacagtaagtccacccgataaggtagttatgaggatttttttaataatgtaaaagacatttagaacaacagtgcctggcatatagtaaatagatgctcagtaaatgttagtttttattaagatgattatttgctggggaacagagatgtgactctcagaaactcctgagaatgtttgccctcctcagatattactctctgcagccctggcttgtggctccctgcttcattctctacactgcctaaggaaggtatccagtgccttctgggcttgtctgtagacattatggggtagttgaggaagcgttggctagcctggcttctagattctctgttttttctcttgaggtccagtagttttccttctctgggtcttttagtgtccttgtgttacacacgaggttaagaggacttgcctgctttctagtttgtatttcatgtggctttgagcaagtcagccccctttctgaatttgtttcctctttttgtttttttttgaggcagaatcttgctttgttgcccaggctggagtacagtggtatgatctgggcttactgcaatctctgcctcctggggtcgagtgattcttgtgcctcagctgcctgagtagctgggactataggtgtgcaccaccacgcctggctaattttttttatttttagtagagatggggttttgccatgtt

SEQ ID NO: 17120 - DNA, 1314 bp, Homo sapiens
tcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgctctccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcagtcactggtttttttcttcgttctcttttttttttttttttttttgagacagagtctagctctgttgtccaggctggagtggtgcagtggcgtgatctcggttcactgcaacctccgcctccagggttcaagcggttctcctgcctcagcctcccgagtagctgggattatgggcgcccgccaccacgcccagctaatttttgtatttttagtagagatggggtttcactgttttggccaggctggtctcgaactcctgacctcatgatcctcctgcctcagcctcccaaagtgctgggattacaagagtgagccactgcgcctggcctttttctttgttcttatatttttgtcttttttttttttttttttttgaaacagagtctcactctttcactgaggctggagtgcagtggcgtgatcttggctcactgcaacctccacctcctgggttcaagcgattctcctgccttagcctcccgagtaacagggactaca

SEQ ID NO: 17121 - DNA, 1172 bp, Homo sapiens
gggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttcagggttgcactttggacattgtggaggtactccataaagttgagtcagagaagctatctcaatacttggtttgccggctggctgtagcccaatgatgtaattcccagagaaaggggaggagggaggggggaggagggaatagtgaggcgtgagcagcagtgctcaccataaagggttctctgctcagttgtaggaatttc

SEQ ID NO: 17122 - DNA, 1157 bp, Homo sapiens
tagaagatatatgagctggttgtagcagaatcaagggtatgctcttagaattcataagaatagggtggttaaaagaagggtcttggtaatgaaatttatggtatagagttctggtgaatatatggtatgtagtgctcctaggaagatagtggtagttagggcatttattatgataatattcatgtactctgctataaagaagaggacaaatgagcttgtggcatatttgatgttgaagcctgagacaattctgactctccttctgttagatcaaaatgggctcggttagtttctgctggtgtggggataatcacattatggctaggggtaatgatggtaggagcagtcagaggagttcttgcattgtgatgaatgcatataagttaaatgaaccacttatcagtaaaactgataacaggataatggctagggtgacctcatttgaaattgtctgggccacagctcgtgatgcgccaattagtgcatattttgaattagatgctcatcctgatcatagaataaatggctaggattgatatggctagtataaataggaggcctatgttaaaattaattagaggatttggtatagggaggggagttcataagaggagatcgataggaagggctaggattggagcaataatataaagggtaatagtagatgttgagggctgtaagggttctttggtgaaaagttttattgcgttagcgaatggttgaagcagcccgtagggacctacaatgttaggtcctttgcgtagttgtatgtagcctaagatttttcattcgatgagtgtaaggaatgctatagcgatgaaagtagggataataagtaggagaaggttaattataggtatattgttaatgagaggagttgaacctctgattataaagttttaagtcttatgcaattgccgggctctgccatcttaacaaaccctgttcttgggtagggtatgtgatgatttgttagattgagatagcatcatctgtggagcgagggcactttatgaagtgggccctatttctcttgtcctttcatactaggggaaatgttaaatagatagaaaccgacctggattactctggtctgaactcacatcacgtaggactttaattgttgaacaaacgaacccctaatagcggtgacacca

SEQ ID NO: 17123 - DNA, 1179 bp, Homo sapiens
cggtcttcccagtcaaaaaccattaccggtaaccagcagtaaaaaagagaagctcagaggcactgaaattgcaaccggctcctttaattctccatagcggatgggtggggccaggcccacccacattagagaggctgaaggctcccagcgccctaccccgcccgaggggcggagcctgagccaaggccacgtgatgatgacagacggcactctggctttcctggagctgtctctatggtattcttcccagcccacccgtccctttggtagcggcagtcacgtgacagactccggggtaaggcagatgcccacgtgatcctggcctgcagttgggtggctgcggtgagatacctgggttcctgaagggcgggtggttaggtcgtaactactgcccccgccggctgactctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgaagggtatttgtgaaacctggaagtgggggtgttcaaattgaagagagtattgtgaattagaacacttctccccaccccgcaccatgataaattgctttgatttaccagtaatgttgattgggattatgctttggacgacaggataaactggaaagcgaattggtgctaactgatcagaaacaacccttgggaaggggc

SEQ ID NO: 17124 - DNA, 2666 bp, Homo sapiens
ttcaaagcacacatagacatataagtaaggagaaaaatgttccaggagagtaggttgggcagtgacaggaacaaacagacctaggatgatcctgagaacaaatagaggggttcctttacttgtataggatatcaaaagtgctgttaatcacaaacctcattcaaatggcaggctgtcgagacagtgtcttgaggggctggctgtactgtttattttttcgtttacacaaagaagcaattgagtatattgcatgatgagaaatcacacactagggtcatgttatacagaagtaaggggttggaaaaatggaatgttgttcactccatggaattattggcattcattcctgtgtttcaaatgaaacatagatgcttttcatgaaaactgacctacaaaaagcaatttgatgttctgcaactgctatgaaaacctaagccatttattttagctgatagcagattgcataatatactcatttagctgcccaatcagattgttttataatattacctggggtacaaaatcctctgttcctggccctggaccacagatctacctccacatggcatatttcctttctggggtcaggggtaggggagggggctttgcatcacttgaatttagactcagcctctctttaaaagattgtctttatattgaacacctttttcttttcaaccctgcttgaatactttaggttactatttcctgaggctgtccattctcactatattgtagaattctagcaccaagaagggatcccgttaaccatctagtcctatccatccctcatattttacagatgagacaaatacgggtcagatttttttctccagatgtttctttgagcccttatacacctgcacgcttattctcctggggatcacataattttatttatttattttttgagagacggtttcactccatcacccaggctggagtgcagtggcgtaatcttggctcactgcaacctccgcctcctgggttcaagtgattctcctgcctcagcctcccaaatagcttggattacaggtgcgtgccaccacacctagctaagttttgtattattagtagagatggggtttcgccatgttggccaggctggtctcaaactcctgacctcaagtgatccccccacctcggcctcccaaagtgctgggatcacaggtgtgagtcaccacacctggccaggatcacattattaaaccaaattaaagtttatgtgattggttgcaatatttgtctaattttatatgttttcttcaggaaaactttagaactcaaaaatcatttacagctgattaaatagcaagtaaaatgtacttgtggtcattgccgtataacattaggcacacgcttctaacacttctataatatctagattttatttacctcattttaacttgcaatgtctgtctatctcatgaactctccataaatccaagaactgcctgtagttttcaaaatgacatgtgggtttttactgttatcattgttatttcgatagggctttttcctgattttgggtatacaagttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattacttacatatgctctaacaagtgtctcaggattcattaacagaattttatagagtacagtaattcaaatatagcacagtacagagtttaccaaaaacacataaaactttgctagatagacagtgaggtggaaaggaactaaaatgtatctctcttgaatagcatttggggttcaattgaatttgttgtgtttacaacagcaaagcaccgttagcctggacagttgcttatggcatcgatagggttggataatattctgggatttgttgcagcagaattcctctatctgatgatcagcagttgaacataaacttcataattatagtaaaatttaggaaaaactatgagtgtgaagagtatgaactgattgggtagattaggcagagtgcattatgggcaagacaaaggttttcgatattaacttcttttaaaataaactttttattttcaaacagtttcagttttacagaaaaaatgtgaagctagtacagagaggtctcatttaccccacacccagtttctcctgttattagcatctcacattaatatgtggtatatttgttacaattaataaaacacattgatatgttaatattattaactgaagtccatactttattcaggtttctttagttttt

SEQ ID NO: 17125 - DNA, 1579 bp, Homo sapiens
acatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggataaatcttttctttttgccttttggccctaggatcgtgtttaggaggattatcccaccccgagattatataaatcttatcctatatttctctaacttatatggttttatttagaaaatgttttgtcctgtctggaattatcttgatgtatggatttaggtattctaacttttttgccccaaagggttagccagttgttaacatatttaccttttcccccaacatatgaaatgtcatacatgtatatactttattctgtgtttggattccctttagttccattgaacattgtggcaccagtacaccagcctgtagatgagttagaaatgggactt

SEQ ID NO: 17126 - DNA, 1222 bp, Homo sapiens
atatcagtaaatatccagtgagggttcaaacttccaattgcctcataaatgctacttgttttattatttttaattagtagaatcccgtaaatctcctaagtgtcttcttaatccgtatgtttccctttcatctttctttttttccttgcgattttgtttatgaaatgaggttgtttcacatgtagcatttgccacaatttaagttttgctaattgcatccctatggtaatgtttgctttcctctatcctctgtttctttaatttgctagttatgtctagagacttgatgagattgaaacatggcttttggcatgaatgtttcataggttatgttgtgttcatttagtaggtggcgcataatctgtggttttctctctttttgtggtattagcagctgctgcagataaatgcattaattcatgatgcttctgatatgatgagtcatctttgtagagttactaagcattagcaaaggaggaaatgctatgtaatagaaatattattcaatgccaaaatattttcttaaatagtcatagaactaacaagaaaaaatagatagcaaaaaaatgtgttggctgttctcactgtttatcttcctaacttcttttgatgatggaaggcagttttgtggaaattgccagccaggactttgacatgaaacagacccagggctaaattttggctctgtggtgttggataagtggccttgaataaattagttattaagcttcagttttctagcttttaactgattataacaatgcacacacatacctgacacactgttaaattttcttctcttcctgtttcttatgttaaggaaagatactctgtgttttggcatatgttggtgaatttgtaccatttttatcctctcagtccttccttttataagacaataattggagtagtttaatcttattcatgtgcagataaaagaggtttatgaagtttagggtgaagtaggcaagggaatctgtttactccctcttccctctactgaataattttccctctactgaataattttccctctaagaattgctgtgggtaataccaggagtggggacattgcccacatgcataagagcgtatctctccattcgatcagtttgtcaccatctttgctctgttttgaaagtcaggcttctctgtgactgtgaagcctgctgttccctgaaaatctgataatggagcagtggaggtttttttctttctgtgc

SEQ ID NO: 17127 - DNA, 1267 bp, Homo sapiens
tacatgaatcagataataatggagacattttatataaggtgttagtgagaagtagttctacttttccttttttacagtgtggtcctggtagcaaacactattagttgctttcaactattgtaacccagtattgtttacatgtggatacttggggataacaattattatggcactttaacagtgcactttaatatataccaccttgatatacatctttactgtctttataatttttaagttggttgtacttattcaatgaaaaagcaaaaaatacacataaatttgtaattcaaagaaatagaattttgtgtctaaccatttaacagttctcccttagtattttagaaagattttaagccattttagaaatgtgttgtcattagttaagtcctcttaaatagattattattattttcctatagaaaatgcagaggcctgaggtgaacgcaagggtcataggcatccattaagatacataactatatagatatcttaaaactctgtcacattgtttccttaatcccttagacctatttcctcccatgaaaactatcataagctatgcttttgttatggtctatagaattttcaaaggacaaattttttttttttaggataaagatcttgtgattgtccgtgggctcacatggtttcttttgttcaattttttcaaaagatttctttttcaatactgttgtcccaccatgatagttgacatggcatgtaattacagacagaagtgtgactgtaaacatattagtgtttctgttagtgttggcataagcttgcctttttgtttaaacaatggaacatgatttaattttatctcatttgccttttgtttatcttcagtccttgatttattaacattttgccaattgaaaacacaataaaaaatgccttgcaggaaggtttgattctgggggatcctgatgagcatatttatcatgagtttaaatatgttaatcttgacatttttaccagttatctcattatagtgttacgtaattgaaagccttgaatagtaaaagtgaaacttgttgaaatacgaggatcatctttctctgtggattaaatgcttcatattctcatccaagaaaaataagataaggcattagtataacagggtatttttgactgttccttgattccacataaagcaatgattaactccctgatgggaatattcataatcccttggtaattattggtatcaaacagatccacttgataacttcatgatgatataaactaaactaaatgcaac

SEQ ID NO: 17128 - DNA, 1192 bp, Homo sapiens
ggctttgacacccagcagtaagctaacagtggacacagatactctgactccttcgagcaccctttgtgaaaacagtgtctcagaactactgacaccagccaaagcggagtggagcgtacatcctaactctgacttctttggacaggagggagaaacccagtttggattccccaatgcagcaggaaaccatggttctcagaaagaaagaaatcttatcactgtgactggcagctcatttttggtatgaagcaactctattcattccttgccatgtggctaacttttattacagtcaattttgaggatattctggactaaatatttaagtgcagtcatttctttttggtttgcaaaaagagcacagccctggactatgagtttggagatctaaattctgatcttgagtctggaactgacaagttgtgtgaccctcagcaagtcacttaacctatctgagccttaatttccttatttataaattgtggtggtttgaacacattgctcataaggtcttttcagttttgttttgttttgttttgtgattttgtgctttttcttgaaaattttcgggcattttgcaattattattgtttgtacttgtaatcagaagcggtttgagccctgtagcactaaataatgaaagattgaggaactggtgttttacattaaaaatttaatggaaattttacacagtacgaaaatctaatgatagagctcaaaaaaaaagagctaaaaataggagttggttcttcttagctgtttatccttctaaccttttttttaaatgatgaaggtatgtttttgttgtggaaaatacaagggcttttgttatcactcagacccagagtgaaatgtttgctttgtggttttgaataagttggcctttaataagttatttagtctctcttagcctcagttttctatctgtaaaatggtcatagcaatgtgaacatatgtgttacatcctagacttatttttctaccccagtaggttgtattgaaaggaaaatgttatatgtgtttcagcatgttttggtgaatcttcattccctttcctgccccttgttttccctcctcaaaggggagaaattagcacaaattagtatcaggattgtgcaggaaataaacatttgtgaaggttaagaaagaggaaaaggaagttatttcttcaacagattaaggatttttctac

SEQ ID NO: 17129 - DNA, 1129 bp, Homo sapiens
agatgacaatgatgcttgcactatcaggaatttaccatctcgttgaggaaacccttgcataggacttcctaggagctcagttgattgtgacattttcccagaagagaggctttggggaactccttcacccctcttgctgctttgggggaatctcctcccctaccaccattccccctcccctgccctgctccagctcacacgtggatggtactttggggaacagtgactttcagggtgatggcttgctggcctgatccctgactttccaatcctatagtcactccaaagaagaaaatccacatggtatgtatatgtgtgagggttgggtctattgagaggtgggactttaattattgttattattattggtgcttatttttcctgctgtatatgggggtgggggtgggggggaataaaacaggaatgtatatttaggtcatgttaaataaaatggctggaggaaggagggaagaaattaggaactgcagtacatcatcaccccaggtgtaagagttatttctctcccagtgcagaaaggggagtgtggcccctggctgtacctgagcttcctcttctccatccctgagacatcacagaatcacccgggttctgacctctccacttctagctctcactgacatctggatatcttgatgcactgcctgtttgtaacaacatatacttctttgctgaatgctaataaacttctgggttcaagagggaacccctcagtcactaatgtgcattcttgtggtttgttccacagtagtgtgcctgtaacccatggttgttgggattgcccttggagagaaattgagaaaccaaggaggtggtgggtggaggtggagtagggagaaccagcaggggaaacagaagccagggctgaaattgaaagtagaggaaattgcagtttttcatccaagccatgccttatatcccagtcagatgccatattggcaaactctctatcacaccttctatgccttaagacctgccccttaagtccctgtgcactgccaggggctggctagcacttctaaaattagcctcaatttctgcaagtatgtggcctccctaccagccaggagacaaatgtgtgtacctcctgctgatggctcaatcaaaaggt

SEQ ID NO: 17130 - DNA, 2976 bp, Homo sapiens
acaggctaaacctttagtgccccctgcccctttcccccaatgaatgatgaaccactgattagcagccaagtctgcattgcctcccgcttggggaagtggggcttatttgctattagcaatgtgaaattatggtacagatcctccccacccctattccttttggcctggcatagctgccatcattatatcagatgactataagctattcatcccagctagctgtccttagagaggatcaagtagcgtgtgtctcacagcctatcgctgtggactttggcatcatgaccagatgggggccttttaactgtcctgccatagcttgggttaaagacaaaaatgctaatccccttgatggagtgataaaattcatccatttgcaaacagaagacaaaacaaggttctgttgtggacactgccatagagtgttgagctccggaatgataggattttttttccttcttttaagcttgtgactacctgagttgcagatgcttttgaatttttgttcttttttcctctaaaggaaattttcataatctcatcacaaggaacacggtcttttaattgagataagggaagagaagcaacctaaattaggcttgactataggggctggggtttttgtggagtgtaggggaaagatagaaaatgagggtccatttatcacagccagcaagaaaggggatttcagaccatgcagagcttaaggtatctcagtttcttaaaagggaaaactcccttctcaagcctcccaacacaaaatgttccttaagccttgcccatcccatcatttggactctgtaataaggccccaggtttgcactcccaagacaggataccaaaggcatctcagctgctgttctgggccctttaaagagcttttatcttccaattagccgagtccttagcatcatcaaatgacagggcttcttggcagttgcagccctttatggaatgaatggcaccctcccttctcctgcatccatgcagttttcatgttaaactaggttggaaatactggtggggaagagcttgctgtcaggaagacattggaacaggctaatcttgccaagctcaacctctcattaatcacctgtaggagagggttccttttacatgtctttattggaaatggcatatggaacattttttgcttggctgtgttcactcaaattatgattattgcaccctcgccctcacatcccaccatctccatgcctgttgagagaagaagtcaacagggttcttgccattcctgagatatggcaatttagcttgggaacagatgctgtttgccccctaagtcaaggtgactttgtgggcaaactgtttcttggccaggggatgtgtccatgctggtctttgtcaccatttctcagattggggttggcccagtgcccttactcacaaatagcagacctggctggtagaagctgcacccctggaagcaccacatgaatttgcatggcactaacaccaccactcaagggacccagaccagctcttcaggctgactttggctacagatacattgtgaagaaatgtatctgttgtggagctggagaatgaaagagggtgaggaaggccctccttaccccaagcacagcattccaagagagaagtgcccaaattccaactttctggcctcttaccaaagctgctctgggatggtggggctgaaattggcctggctatttggcaggaagtaaacactcaccaaatgcctttacaacagggaagaacccacctcttgcctcttctttcagggcagcttgagctcctgtctacatgtggactgtgccagccacagcaggcggtagagccatcaccagcctccagaccctgctggagaagggccaccagcctatctgggaagagaaaaaggaggtggccaacctttggctaagggctgagagctgccctcaggatcaggaaggcagcatgaggcattgtctctgaggggcactggcatagccctgacacactttgttgggctttggaaggtcacacaccacagagtagggcctggggctgagtgagagttcatggtttggacagccttgctgcctgcaagtcccttcactgccctagccagcccaggaataggatccttaccacctgaagtggggcagccaggatatgtggctgcagaagcaggttcctttgaatttctagagctaagcagtttgtggctgaaacccaatggcagcctaggggaggaaggaagacctgtctggggacccatggtgttgacagcacagggtgacattgggagagccagccaagcttcaggcctgtttccaaacacagactagtgctggcttgggtggcagcaaatacaccccagaccactaaaactgttgatatcatgtccacacctccaagagtactactagatgaacaacatgtctccattgcaaggtcctggaataatgcttttggatgtgattttaagggaaaatgggacttagtggaagtagctgccttcatcttattacccaataggcctagtgccagacagctgtgatcctgagaattcccagatgagactggtccttggaggaccagtgaatgtggatagagaaggccacctagtaggcctctcccagggccaggatgccagtttcttggtgctttagagtctccaaggaagcactgccttggggcccagttcaagccagccctacctatctggcctcagcttgggtaccaggccacaagactgcccggataatgggttcagtaaacaccagtctctctccctccttagtcctatgccaagaagggaagtagcttcacacactcaggaggctgggtgtgtacccttcatcctgctgccagcagctttccttacctgtgccagtgccaccaccccacctgccctcagcccccaggcccagttgctagagggaggcatggggtttagcagggagacttcaagtttacccatgtgtatgttgcattcaagttgttttt

SEQ ID NO: 17131 - DNA, 1181 bp, Homo sapiens
cagtggtcccctgagcttaggatggtctgaagggagtggacccagcaagaaggtaggggatgaaggcttcttgttgctcagtgtagagttttgcttccttggggcccagagagagctggcccagcaagccaagcatatcgagtggattaagatttgccccacattttccatcattttctttcttgttccactcaagcctgacgtccggtgaaagcaaacccagcctggatgcttgctcactagtatctgtctctctgtctttgtctctcctatctcctccagaccccactgtgatgcttcctgactgataatgttataacagtgcctggaagcctgaggctgcatttccagctggacgtacctcagttgtccccatcatcatggagacccaaaaggatgaagctgctcaggccaagggagctgcagcctctgggagtacccgtgaacaaacagcagaaaaaggagccaagaacaaggcagctgaggcgacagaaggaccaacctcagagccatcctcatccggcccaggtaggctgaagaaaactgccatgaaactctttggtggcaagaagggtatctgtactctgcctagtttctttggagggggacggagcaaaggttctgggaaaggcagctccaagaaaggtctcagcaagagcaagacccacgatggcctgagtgaagcagcccatggccctgaagatgttgtcagtgaaggaactggcttctccctgcctttgcctgagttaccctgccaatttcccagctctcagagtgcccatggggctttggagacaggctccagatgtaagacatctgtggctggagccacagagaaagctgtggctgagaagtttccctctatgcccaagccaaagaaaggcctaaaaggcttttttagcagtatccgccgtcaccggaagagcaaggtcactggggctgagcaaagtgagccaggggccaaggggcctgagagggtcagagccaggcctcatgagcacgtgagctcagcccctcaggtgccctgctttgaggagaccttccaagcccctagaaaggaaaatgctaacccccaagatgcccctgggccaaaagtttctccaacaccagaaccttctccaccagctactgagaaaatggcctgtaaagatccagaaaaacccatggaggcctgtgcctca

SEQ ID NO: 17132 - DNA, 1430 bp, Homo sapiens
tctgaactgggttatgtccttccttcccatcttccatggcatccaagaatacttgagtctactcactgattattgctctcttctgatgggaaatcactttgctttctgggcccctggggaatcagaagtctaagttgttgcctggaagaatctgactactaactttctttttcctgtgtccctcaccaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctg

SEQ ID NO: 17133 - DNA, 1151 bp, Homo sapiens
aaccttgtttataatctagtaggtcttggaggttgggcctgttggtttttctgaaagccattaggactcagttcattgctctgtagccaaaggccatcctttcatttctgagcagtattcttataaacatagagtgttggtcctaagaggatctaggagagagtgtacctgactccatgaggtccatccctactgttagcccctaaagtcagcacaaactcctgacacattactgctatgcttagggaccacagcacatcatttgatttgtggatgaaggtacaaaggaaggtgttccccttgttgtttttgatcatccattcttgtagctctcttacctttcaggcaattccttgtgtctagtttaacaccttcttgctataatttcggtctgcttccagtgtgacctcaattggctgactctacatcctctttgcatcagccccttagaaagctaaatgggcttcccttctctcctgcacagggactttgtgctttaaactactcatcacccattgtctttccagagtcctggaacagcacaaactcaacaaggaccagtgggaggagcggatccaggtgtggcatgaggaacaccgtggcatgctcaggtaagcttgcccaagcagtggtgggccccacttcccttacagggtgaatgagaatgcgttctagggagaagagactgatgacaagggacattggtggatgttggagaaagagggaacagggacgatagaaggcaaactaggaccattataaggctgttttttgtttgcttgtttgtttgttttgctgaatgctggtaactggtagcccaaacagttttgactatcaagaaatggagggagctcttacacatggcaaagcatttttgagggttgtgtagttgaaggacaaatatcatcattttgccatcaccacattctgagccctgctaagaatgtgcctttataagaggctgtcacaatgaatgagagaaagaaaattgcttctatggcagccaacatgccagaggccagcaagggtcagcccatctttattccccttgggagcttagaccctaggtttttgttaggagattttgctttgcaaaagtcatgctgtgctctgttctccatcatctgcttgccttttgtcccctttcccac

SEQ ID NO: 17134 - DNA, 1133 bp, Homo sapiens
gacaagggtatagaggtaagggagggtggcccaaactcacaatccctaagtgtgttgggaaggttgggttgagagacccagaggcagcaagccttggaattccccaggcttttttttttttttttagatggagtcttgctcttttgcccacgctggagtgcagtggcgcaatctcagctcactgcaacctccgcctcctgtcttcaagcaattctcctgcctcagcctcctgagtagctaggactacaggcgcatgccactatgcccagccaattttttttgtatttttagtagagacggggtttcactgtgttagccaggatggtctcgatctcctgacctcgtgatctgcccacctcggcctcccaaagtgctgggattacaggtgtgagccaccgcgcctggcctccccaggcttttgtggagcgttgttatcctgttctatccattttatctccttccctagtgctatgctggaaaatgagaagaagaagcgtgaaatggcagagaaggagaaagagaagattgaacgggagaaggaggagctgatggagaggctgaagcagatcgaggaacagactaagaaggctcagcaaggtgaggcttggagtcaccttggagattggatttttccaggcctaactctgagctggagaaccttctgcctgagctgtagactcagacaatgtagttcaggtgtggctacagactagaagaagaatgggcaagaagagagctcagaactttctgccagctttgtcttggggtggatcatttccaggaacgaagctattgtgtcgtctttatctctgtgctcttcactgccttctcccctccttttctgctcagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggtaaagctgtagggtgggctgggattatgggaactgaactttcttccttgtctgcctacttacttatagctacttttgcttacatgctggctttttagagcaggctaccactccatgggcctc

SEQ ID NO: 17135 - DNA, 2063 bp, Homo sapiens
ggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttcacagtgactcaatcgttctttgtggtatgagtgggtagctgtaagatatttcactgcagtttctatttatatattaccttcttatctttggtctcatttcatctatacctcagttctatggagaggggtgatatgactatccccattttatataggagagaatgggctcaaaaaagtataataacttcccaaggtcacaggactgtctaacttaatagtctgtgccctttcggtagttccaggccaacttttctactgtgggtgtggatcctgcattgaccatgtgatgctcctggacttgcctggcattgggacctaagaggtacttatttgtatctcttgatttctcttgggatgctcaggccctgtcctgcctctttgtcaggaaggtcttcaggcttttcctgcctcctactaccctcacatattgtagtgccaataaaggtcagggaaa

SEQ ID NO: 17136 - DNA, 2742 bp, Homo sapiens
ttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttgaggttctcaccaccctcagcagggagaagggctgaagttcgccattttggaaccttacagaacatttctgagccaaagtaatcttccttctggggcctgagttccccaaactaccccacagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagaaaaacaagttccttagaggttgtattctttattctccaagaatctgtctgaaacttgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactagcaaaaaaaaaaaatgtagtttttgtttgtaaggaaggggaggtatttcctgagaatgaatttttttttttttggattactgtttttctctccatataccttgacttggattttgacaggagggagcctgggaaaataattttttcctccaagattctcagatccaggttaggaaaggattcagcactacagcatacccctctacaacatacagccctgtcacattgagatcataatccctcctgtcccactcctctctaccaaccccaccctactagctaggtcttcagtgttttacattgaatattggtacattttaattattttttctcataaatgggttatttatagaaattttgttaactcttgagccatatgcatgtgtagatactggcagggctatgtttgtttatgatgctctgcaaacatttcatattggccaataaacagaaatatatccaaaaaccttgtttattcctctactttcagagaacctggtgaatcattttgctcatgtgtcttttcttagtgagcacagcaaaaaaatgtgtttctgatcattggacatggcatcagtagtgatgggattcactgacttgtcacacaggagatctgggttatagttcaagctctctttctttttctaaaattgtttatgccatttatattctcctctgagataaggatctactagaaattgttgtgttctaaactaatacttatcaaacagggttccatggtcctaagggaaccgtgcactgcacatcttctgaggtctgcaaaatctttaggaatttcagtgtgtgtgtgtgttttcattttgatcataatgtcttaaaatacaagcatattctagctagacctgttaagagtactgccttgccatttcaaggtctgtatttgtgttgataatcttaccaggttaaagagaccacctaaagagaaactatttaattttgaatgctatactttactataatttaatttaagagataggaaaatcaagtttccttccatctttaatattctgtaatctttacaacaatacatgttggcaaggatgtggagaaatgagaagcctcatgtattgctggtagaattataaaatggtatagcctcttttcaaaacagtctga

SEQ ID NO: 17137 - DNA, 1240 bp, Homo sapiens
gaactgagacacagagagggaaagttagtttctcaaagtcacagggcaaattagtgggctagaactgtgcaagaacccaggtttgggggctacattttagagttggttcaactccaccattgcaaccatttgatagccaatgttactttctcaaagcttatgtagcatgaggtaggagagtaggtagattcccagttttcaactaaccaaatatcttgcagtgcccacttccgtatttcttcagttaatacattttcagttctcccaatgacttccctgctccctgcatccaacctaagaaaacgtgaacaaatgtatatttgaaagtcataactgatatcaaatttgaaagttataactgatgtcaaatcaatcaacttaggtaccttcaaggttatctagtccagttcttcttccaaggtttgggtccattttataatatccccactaagagtttgtgtagtccttgctcacatactttaggtggcagagggctgactacttctcaatgtatattacagtatacacaattgtgactggtgggtttgagctcaatgtaagaaagagctttccctgtagtacccgcctatccatcctggctctgttcctcgtgccagacagacctcatcagtttcctctgctttaagatagccctgcagaggcttgaagacaacaccacctctctggagaataccactttaggttcttctaaagtatgtggagcttagaactaaacctatcttcaggataaatggtttcaacaatgtagaatagggtagaattgtcatatccctatctaggtaatgtctttctgctattacatcctcaaccattggcttaacctatgatatttggaggggtagagaaagaagggtgctagtgagatttccccacatgtttctaacttggtttgctctctccttaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcat

SEQ ID NO: 17138 - DNA, 1259 bp, Homo sapiens
ttgaaataagtcctcggcctcggctctctgaaaaactatgttgcagaatgcctttatctctgaggatcaccagtataactaaacttttagtgtaattctgtgttctagatgatgccaagctcatgaatgtttagtaaatgttaatagttgtgacaatattactgtattaaacattcctttttgttttgtcttgttttgtttagcctccacagctttccttgctgatagccagcctccaaaccgcagagccctagctgtttatcctgttttcctgttttactttgtcatcagttggatgattctcacctttactcctcagtaaatcaggaatgggaaattaaaaaccagtgaattgaaagcacatctgaaagatgcaattcaccatggagctttgtctctggcccttatttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattct

SEQ ID NO: 17139 - DNA, 1153 bp, Homo sapiens
ctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggact

SEQ ID NO: 17140 - DNA, 1146 bp, Homo sapiens
gcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccag

SEQ ID NO: 17141 - DNA, 1349 bp, Homo sapiens
tgcggcttgggccgctctcggctcacacacatctgccgggctgacctcaggtatcaggcctgggacagcctgctcgacccccttggccttgaccccctcccctgcctctgcccctactttctgccccatgctattgatccctggggctggggacaagtcctttcttccttctccctggtgagggctctggggaaaaatccattgctcatgcctggtttcttctgcttccctaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatg

SEQ ID NO: 17142 - DNA, 1182 bp, Homo sapiens
aggacggacatttacaggtacagtaatagacagtggagatggtgtcactcatgtcattgctatggctgaagggtatttgattgccaactgtattaaacacattccaatcccaggacgaaatataacatattttattccgcaactgctgagagaccaagaagtaggaatccctcaaaaacaatccctggaaactgctaagacaataaaggagcactatagttatgtctgcccagatttagtaaaggaatttaacaagtatgacacagatgggtcaaaatggattaagcagtataccagaatcaatgctatctcaaagaaagaattttccattggtgttgtttctgagagacttttgggatttgaaatctttttttcatctagagtttgccaatccagactttacataacctatctcagaaattgtaggtgaagtaattcagaattgtcctattgatgtcagacggcctctctataagaatatggtcctctctgtaggttcaaccatgttcagtgactttggatatcacttgcaaagagatttgaaaagaactgtatgtagatgcctggctgaaattaagtaaggaattgagtggcagtagattgaagccaaaatctattgatgtacaagtcgttacacaccatatgcagccatatgcagtttggtttggaggatcaatgctggcttccacgccggagttctaccaagtatgccacactaaaaatcattatgaagaaattggacctagcatttgccgtcacaatccggtgtttggagtcatgtcataaaaatgacttcatagttattggggttagggaggtggagaagagataatctttttcattatgttttgtctggatggctggttttgaggttttaaacctgacttgaaatagtaagaccaaacgtgattatacagaaatattttaataagtgtatcaacatgcaaatgtagaagagaaagaaagtgattgtattttttttagattgaatatttgaatcgtatgtgtaacaaaagaagtgggttttagttccttctgtgccctggtattttgtatgttaatgaattatccaagatttgatggatttatcagtgtgtagatagctctataattatttaattgtatacttctaagtgtgcaatgcaagagcttgtttatatttcatactttttgtactttgag

SEQ ID NO: 17143 - DNA, 1270 bp, Homo sapiens
tggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacaaaaaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcactcccagagcagccatggaaggagctggccctcacaccatccacctccacactgcctcctggccagctgcccaccccagtgccaggtgggagag

SEQ ID NO: 17144 - DNA, 1148 bp, Homo sapiens
gtgggtcaggcctggcccaggtccttatactcccctatcttgtcctagcccaggcctccatgaaggagaacctggtggcattgccccagagctctccagagatgagcctcccctatccccaccctgtccccgtccccagcctaccaaagagtattcacacctttccatccctgactctatgggttactgtcccaattgcgaaacacccatactcctcttcaccctgtagcagggtcttctgctccagtcaccccggcctcttgcaagagaaagtccagggactggcaagaagaccctttgactaaagataatgtgctgtcatatcttggctgagaaactgttgagtcaggctagaggactggacaagagaagaggcattgagagcccccttgggagccattagccttgctctggtctgctgtgtggggttggggagtaggggggatcccacattgcctgggacatctgaatgctgatacgaatggacaggaaagggagccagagctgtatacctgggacaggccagggagcctttagtgccagcagggcctgtgtcctgggatgtgatgctagtgagtgaatgggagggcgggcctggagctgcgtgagagtgaaaccaagaagcggatggggaagggagagctggccttggtcagcttagggatgaatggagaaggaatcattcatgggcctcggctaggtcccagactgattacatgagactggggagtccttccctgccagttttctcatttattacagcctatcccccaaccctacccctgtgccctgcctacacactcccgtttggccctcagcactttgggcctggtcacataccccatccctagagtgctcttttcagctggggaggggaagaggtgctggctcctttccagacatgcttatgtataagtaaaggggcaggtgcttgggctccagagagaccctaggtactgccttctaactcctgcatcctcagaaggggaaaagggactgggaagtaaagggaaaccatatggccccagggaatggacccttggagactcccatcctctcttccccctcaccaagtgcccaggagacccctggctcagaccagcccaaggccttgcccagtggcaggggaaaggggcacctcactccac

SEQ ID NO: 17145 - DNA, 1143 bp, Homo sapiens
gaatgtttattctgtcctaatacaaaacagttttctctctggtcaaggtcaaagcctctcattaatttttagcacttcttatatacttccctcctgatctgatactctagtcagtcactagactctagtctcttggtgccaatgccaagtttctcatgcagtccaggcatttttctttaatcagtatagcttggaggaatccaagagtcccttagagttaggagtatagaatgcctgggggtccttgaattttattagatttccaacttttcacctggtggtctgtagaaccatttctttagatgtggcagatgctccaatgagttaaagagtggtaagtcaatccaaatctccttttcctttgaaccattcttgttactctgatgagcgtatactatatttattcaatacactcatcaaatatttactaagtaaatacagcagtttatatagtacttgaataaacattcaataaggattttttttaatattcccactgcctagaaacagacttggcacctagtagaccctcaataaatatgtcctgttgccctcaaagtgatttacttccagcataaagaggcagacaataaataaagttggttaaatttgataagtggtatgaagaaaaatatagctgagcaacagggagagagagtgatggggtatgctgtaagatgatcaaggaaggtactctgataagggaacatttgggaagagacctgaatgaaatgaagtaagagctatgcaaatgtctggggaaaaaagaagcagaaaattcaaaggctctgaagcagaagaatgtttggtatgttccagaaagatcagtgtggctgggagcagagtaagaagaggaagagggaaggagatgagttaagaaagcaaaatccaatctagagccttgttggccaaggtaaggactctggcttttattctgcatgaaatggaggaccactggaggattttgagcagaggaatgacaggatctgatgtatgttttaacagcattcctctggctgctgtattgaaaataggtgcaggaagaaaggatacaagcaggaagaatctttaggagagtattacaataatccaggcaagagatgatggtggcttagaccaggatggaagcagtgtgggtgggga

SEQ ID NO: 17146 - DNA, 1121 bp, Homo sapiens
ttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacaaacagaattttccatttattaagcagtacaaatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctgg

SEQ ID NO: 17147 - DNA, 1277 bp, Homo sapiens
tgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctagagggcgagggatgatgagggaagcaataggtagctggggagccctattgctgctaagtcattggcaaagtgacaaagcaatttactgatgagagaatgtggaaatagatgtgcagtttggaattatgttggtgtgaatttgccagaggaccaatgcttgcatggagaatgggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatccatgtatgagtgtatgtgtttatgtaacttcctgtggatgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggg

SEQ ID NO: 17148 - DNA, 1164 bp, Homo sapiens
tgagccagaagagctgcgaaagttttgcccagaagaaaaaaagagttgatcattttttaggctgtttcacaaggcattcctgcatcagtggcaggtaaatgacccctaagattctatgatttttttgaaggtgtagttcccaaaatggaagcatcacaggaagcactgtgttgcgatactaagcacccaccctagtaaaggccagtataatcaaatgactaaggtactcatcttccctaaaggacttgctgagatccggttacttctgtatttttctggcttcagaaggtactcctcagcccctgctgggccctaacttgtcatctgagggaactgcctggtggctaattctggggtatagaatctatatccctgccaaggtggaaattggtatgcttactaccctatcatttgcaaaggtaaaatcttattgaggccttcttttgaaggaatacctcttcatttgtaagttcatgggtaatgcttttctgtggaacagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggtaagcctggccagagaaatctactgccagagatttgagtattctacaggagatcaaattaagatccttttaagtctccataaaatcactgtttttatcaagatgagtatagaaaggccgaagggtcactaaggtagctttctctttaatttaatgtgttccccagtgctttttaatctgtaacacacttgtagtcatttgtaattttgtggtataccatgggggacagaaatgtctctgaaataaaaattggttttggttgtggaaagctgtggctgctgagggaaggcatagggagttaaacctttaaaatctgtgctaactggccaccacggtggctcatgcctgtaatcccagcactttggaatgccgaggcgggtagatcacttgaggcccggagtttgagaccagcctggccaacatggcgaaaccccctctactaaaaatagccgggtgtggtggtgcgcgt

SEQ ID NO: 17149 - DNA, 2079 bp, Homo sapiens
gcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatggg

SEQ ID NO: 17150 - DNA, 1168 bp, Homo sapiens
tgctcacttttaatctgcagcgaggttggtcccctctccctctggggggtctgggggctgtgtctgtttgaagccccgggggaagcccctgggtggagctctgtttaattcccaaatagccacaggccaaggaactgacacattaggtttcaagattcctgggttgagattaggataaaccctatcagtttctggcaagagaaagagacctaatattgattgagcacttactaggcgccagccactctacttcagggggctttcacgtgccatttctgaaattagcccttccaaaaaccttgtaaggtattgtaattcctacttgtttatgaagaaactgaggttagaggtaaagtgacttgcctttgtcccttccatatccccgtcctcatttcccaatagctcctttgcttggtggagggggtcttgtaattcgctttcagagtttagggataatgagccctgtcgaggggtttttgtcttgtttttcaccagatcatcttcttcaattcctgctaggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtgagatatggtgggggagggagggaactgcacagccagcaaaggggtttttggtcaggaaatctgggtggaagtattctttatattattcacaggacctcaatctccctaaatgtgcgggtttgctgggggtctgggggggggtgttgaaggtgtggagaaattgctcattctatccatctccgtcctggtttccttaattaagtgaatggttttggttcttaaaaagtaataataggccaggtgcagtggctcacgcctataatcccaacactttg

SEQ ID NO: 17151 - DNA, 1217 bp, Homo sapiens
cctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactgtggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaagcctctgttttcctgcttaagttgtaaatttagtattctttagtgtctaggatatgctgggtattatgcagaaatcatacagtgtggccagtgtcctgaggtaatgttttgcatttaaatttttttagaaagcagaatcttaacttatcttaatgatatttacctatcctttttgcaactcacaactgactttgtcacagaggtaatgcatctgcttg

SEQ ID NO: 17152 - DNA, 1156 bp, Homo sapiens
ggctggatagggtggggtggatggaaaaagattagagtgaggaattcaaggagataggaatcacggctgtagcgactgaaggaagggagggaggatggaagagggctgggggatggaaagccaaggcgatatatcgctgagctccataactaaactaggttgtgagaagtctgaagagggagggcaggaaggccggctgctttctaatgaggtctccctgggataatggagtaaagcaaagccttgaattaaagggaaggtagattccagaaaaggcagacagtaggcttgtgggagcagaaataagaaagggagtctccttgagaccgagcgctttcctaacttgtgtcggatcagcatctgaaggagagaaatgttttatgcttaagttttcgcagatactacgtgctgtctcgccttgaaacctggcctggccctgggattggtgccttgtcagtcactgctttcattctatgtggatcctttagatttgaagtatccagaatgtttatttcagtatttattgactctcgtttaggtactttgtatatgaatggctttttgccctttctgtcctagattacccttttggattctgaccctggtctgtagttactttaatacatgacatttcagaattgcccaggagtggcttcttccagcatgcatgatagaggactttactctctagtgcttagcccataatgcaaggatggaatgtgcagatagagtacttggtttgcaggatcttttgcccacttgaagtggttataggcaaaacagtttgagaatcattttctagttttccttatgttttcttctcagactaaaaggccagaatattctctgtggacagcatcctgctcaaacagcattgaagaactaaaagagtgtatgtgctttcattgttgaaggagtgaattgaatgagaaattgtggtctcctacttgggctttgaaatcttattgagaaattatgatttccagattccaagtttggcaaagtccaaactgaagaaagaaaagtgaatagcaaaacatgagaaacacttgtctatataagaactatgtgaaatcatgtctttgggggagaatggaatttaggtccttcagaatatgataaaagcaggaaattgtcagtgctggagaacttagtt

SEQ ID NO: 17153 - DNA, 1493 bp, Homo sapiens
caaaacacacacgaagccctgggaagagcagagtaccaggagcttttccagggtgggcatcccccgtgctctctgcagtggattattacacgttatctcccacccgctgtacagagaagtctggagcagaggctgagcagcttgtctgggagcgggaaatgtgtgtggtctcccctcacaccccacccccacccctacttctaccagttttcccccctggattcaactttctttgagtctccaggaatacccctgctgtgttccagcacccttttatcttttatctttttctctttttttgtaaattatttaaagtttttcttaaactttaatgacctgggaaatgaagccccgaaatgaaccctgctgcggtggtggcaccaaatcctaaaccctagatcatcagggtccagcatcctcttagacttgaccgctggccactgacctcccctacagtacctcacgcccctttcctgccatctctgcccctccagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggat

SEQ ID NO: 17154 - DNA, 1945 bp, Homo sapiens
catattacagtagcatagtttccggatgggacctccaggccccttagctgtgcccagccctgcaaggtagcacagaaaaggtatgtgtatggaagcgggttaggtgccaccatcttctttggtgggaatctggatgatagaatgttggcaagccccaggtaagcctcttaccttgttctctgtttcttcttcccacagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccagctctggtttctgctgccttgcttctccccttggataagggggagggaggggaaaaggcaaagggcgggaggaagaaactgcccaaaggcagagacatggaggagggtgggggaatttcaccccggggaggtggtggagtgtgggggtggagggacacctaacccctgcaggagtaggcgggctgtgagataggcctcccaaggggaggtagtctggtttgagaagaccccaccccctactccgttcctcaaaggctcattgtactagacttcacagccttcctcaccccc

SEQ ID NO: 17155 - DNA, 1099 bp, Homo sapiens
ttcaggtagagagtagggcatgctgtgtggggcattgggttgagcttgaacttgtactctgccagtagagaacagaatctgcctgccaccttgccccagttgtggttctcttcatcttttcatttactttatctgcttcatctctaatagtcccctcttccctcccctggtacccataggatggaatgctggacagacatgagttcctgacctgggtgcttgagtgttttgagaagatccgccctggagaggatgaattgcttaaactgctgctgcctctgcttctccgagtaaggcttggaattttggtactggtggggcagggggagtctaagaagaatttgaggaagaataaaatgttagagcagggtcccctggagagaactaggggctctgatggtcgtgtcttcacagtactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacaggtaggtactaggcgggcccaaggaagcattgagagatagcctgagaagaatcaggtgcccatcccagagaataggggtaattccaaattggatgtgggagtaggtgctgagtacttgcttggaggttgttgtttcttggtaatggggtgttagtcccctttgggggttttcaccagcctctctctcccttccaaggctaaatagtgggcccaaagccttttaggaaagtgagtgaagggaggggatcggggtggagtgatgcctgtcttggggacccagtcagaataactttggatctggaatctacgggttgggtcttagaatgggattccagaggggtaaccatggtgaatgagttggacttagctgtttctatctggtagaccatcctcctgtgctgtcctagtgccttggtttggcactactcact

SEQ ID NO: 17156 - DNA, 1985 bp, Homo sapiens
tctccatcttgatgagactgtaatttgtgtcgtgacgccttctccctgtgccctgaactgtgctcttggatgtggctcatggagcctgtgttcttaatgagtctgaatcatttccctcccctatagacacgggtcctggaaaacggaagagagaagatgaagcccctatcttagagcagcgtgagaaccgcatgaatcccctccgctgccctgtcaagttctatgaattctatctctcaaaatggtgagttggtgggttggcaggaaaagcgttagcatggggacccgagggatctactttgccttggtactgatcttctgtcctgccacccccactcccactcccacccccgatgttgcagtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtcttttgtcttttctgggtgatggatatagaggagcaacactggataacttcaaatctctccaagtgtaaacaagtcaggtgtttgagaatcgttcttactttactgtcttactttggatctactgggaatgtggtgttt

SEQ ID NO: 17157 - DNA, 1132 bp, Homo sapiens
aagggccgagggaggacctagcaacgcggggagggggggtggggccagacagggtgggtaaagactggggagctggggggctcctgcagagtggggagggaatagaaactgagatcgcgggggcgggaaaggctcctggtggcgacggccttaggagactctaagggggcgttcagcctgagttgcggggggtaaaaggtaaggggggaagggaatgggagttgcagtcgagtaggggggtgggcgggtagaacgaccgactgcctggccagtgtgggcacggggccagggcggggaacgcctctccccactgggggcgctgtattggggggagtggtcattaggactaaagccttcggaaatgcttgtagattgtggtggtgggggctgctcatgagaaatccaagtggatgatggggtgtgtctcagagcctatataagaaggaattcaggctaagaccacctctactgccccctcttctactcctaatctgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagtt

SEQ ID NO: 17158 - DNA, 1235 bp, Homo sapiens
tgccactgcgcctggctaattttttgtattttagtagagaccaggtttcaccctgttggccaggatgatctcgatctcctgacctcgttatccacccgcctcggcctcccaaaattctgggattacaggcgtgagccaccgtacccggccaatggtctttgttttctggatgatctgttgtcattgggagaataatacctatgaaattgatgatcacctaagtgttattgacttctagaactacatgtgatttattgcaaggccatcagaagcaaactagggtggccaaagagctgaagcacacagttaagttctttcacttctgtttctttgtatggttgtttagtttttccggggagatattgaactatactgctttagactgttgatggctgctaaggtgttctttgtcaaactgagttattctgattttcctctgcttcctaggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacgtaagtgagggtcattttcagacgtagaccttagattgctaattccttccatggtctggagagttagcctctagtaaccacttttctatgtttaaagacttttggtcagcctggcatggtggctgactcctgtaatcccagcactttgggaggccggggcaggcggatcacctgaggtcaggagttggagaccagcctgaccaacatggtgaaaccctgtctctactaaaaatacaaaaaattagccaaacatggtggcgtgtgcctgtattcccagctacttgggaggctgaggcaggagaatcgcttgaacccaggaggcagaggttgcagcgagctgagatcacgccactgcactccagcctgggcaacagagtgaaactgcctcaaaaaaataaataaaagactgggcaaaacagcggctcacgcctgtaatcccagcaatttgggaggccgaggcgggcagatcatgagttgaggagatca

SEQ ID NO: 17159 - DNA, 1117 bp, Homo sapiens
aaccccaaattttttataatgtcattaggtataaaaacttcagaagcctccaatcctgagccctagctaattcattgtgccagtgacatgtgtagagaagaagcctggtggggtatgatttgattaacactgaactttgttctttcttccagatttcctcgtcctgtgactgtggagcccatggaccagttagatgatgaagagggacttccagagaagctggttataaaaaaccagcaatttcacaagtatgcagtcttgatagatttccctattaggtgtttccttcttaagaaagcttataaagggatatgtaaaagaggcaggtctttgctgcacatgttcactggcagccattatcttggtcctcacaaggaatgcaattcttagctggggtaattctggacaaagttagtaacctaggaaccttgcctatagggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacagggtgagtctaggcctgtaagtcttaaagctgaaaggacaaaatgacatttttaaatgggtttctttgtatcaattaacagaagggcctacatctctgcttttatacttagtttgcgttgattttggtagataaataggcttggagatgtggcagagatactggattctgtggagaaggaaatgataggtataacttcattttggaatctggacaccacaggtggttccaaaggaattagatcctctttgctttctggatctttatttgaagaaagtcattagatctatatgaagacaatgaggaatattcttagtctgttgtttttttagatttgatgaggcgccaagaagaacttcggaggatggaagagctgcacaaccaagaggtgcaaaaacgaaagcaactggagctcaggtaacttttctcgaacactttttccctaacaactctaaaaggtaatgtctcactcctctttcctactg

SEQ ID NO: 17160 - DNA, 1656 bp, Homo sapiens
aatagttgtgaatccaaatacttcatggctcatgcaatcctggggttgttttggttatggtgttaaaatgccaaaactggatagtttggttgtttctgtttttgtttttctttttttctttttctttttgagacagagttttgctcttgtcgcccaggctggagtgcagtggtgcaatcttggctccctgcaacctccgcctcccaggttcaagcgattctcctgcctcagcctcctgagtagctgggattacaggcatgcgccaccacttttggggttatccactagagttctaaacagacttagtcacccactcctacctaccatcaggagccttgaatagttgaatggaaatagcctccagtggagggactacagatgggtgggaagcttccaacaatggctctgttacagtgttgctctctttttctctttaagaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaa

SEQ ID NO: 17161 - DNA, 1185 bp, Homo sapiens
caacattatttttatttatttattttttgagacagaatttcactcttgttgcccaggttggagtgcaatggcacgatctcagctcactgcaatctctgcctcctgggctcaggtgattctcctgcctcagcctcctgagtagctgggattacaggcatgtgccaccacacccagctaatttttgtattttttgtaaagatggggcttctcaatgttggtcaggttggtcttgaactcctgacctgaagtgatccacctgcctcggcctcccaaaatgctgtgattacaggtgtgagccaccgtgctgagcctgcaacattattttaaagtgagaaatacactgtgtaggttccttttcagtggacacatgaataactccactaactcgctctactaacatgagtaactctttttatctttgccagaatcttgattgaaaggggcataaatgttttctctgttactatttcctccttgcactttgactaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttgggtatattactggcagaggccagtgtttcttctcctttgaaaacttgctgttaatgtcaacgggcaggaggaaatcagaagggttggagatgattaggactagaaacctgtaggtagcggcttgagagagcgaagttttggctgttagtttatattatttgtgtatatgcttagggaacactcacgtaggaatgttggaaagttgcaactttgagatgtcaagagcatagtttgttccgttagtgaatcatggactcgaaacttctaggtagcagtttgagagagcaaaattgtggcagttagtttttattatttgtgtattccctagggaaaactcatgtaggactgtcggaaagtagtacctttgagatgtcaagcgtgtagttcacttagtgaatcatgtactagaagtgatttgggatgggatgaaaagatacaggtgtagttcagttagtaaatcgtggactagaagttacctgggggggggtgggatgaaaggtctagttaagaccttcactgg

SEQ ID NO: 17162 - DNA, 1192 bp, Homo sapiens
agattacaggcatgagtcactgtgcccggcgttgttttgttttttaattagtttaataatttattcaacaaatgttgctctcacacgttgtgtgttgggctacactggggtctagggtagtagtatagtacttggtacattatgaagtgattttcatatgtaatcttcatagcagtcctgtgaggtataggcatttttaagtatctctgttttgtagatgaggaaaactaaacttagacatgttaaatagcttaaatagacatgttaaatcatagaggtaatggcagagctagcatcatctgaattcacatcctgtattttctcccctactgactctgaaagatagtggatgaaaaattgtttagtcacatttgataatctatattttaatttatttgtattactggatagaccttagatggcgtaattaagatggagagcaataagcttggtatttctttctcagcagttgactgaatttcctagggctactctgtatataatttttgtgtttttacttttgttaggcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtaagaatgggaggatagggaggggattgggttgtatacagaaagggtatgttggggccgggcatggcggctcatggctgtaatcccagcactttgggaggccgcggtgaatggatcacttgaggtcaggagttcgagaccagcctgaccatcatggtgaaaccctgtctctactaaaaatacaaaaattagctgggcgtggtggctcacgcctgtgatcccagcactttggaaggccgaggtgggcggatcacctgaggttgggagtttgagaccagcctgaccaacatggagaaaccccgtctctactaaaaatacaaaattagccaggcgtggtggcacatgcctgtaatcccagctactcaggaggctgaggcaggagaatcgcttgaacctaggaggcggaggttgcagtgagccgagatcgcaccactgcactccagcctgggcaacaagagtgaaac

SEQ ID NO: 17163 - DNA, 1285 bp, Homo sapiens
atgtgaagattccaaacaaaccaacacagcagaaggtgagattgtgtttatttctagaatgaaaaagtcaagggagaaagaaatgggtgagtggaggacttggaatgtagttaaggtagcagaatgacttagatgcctacttaaaaggaattcaggtttttaggagtctcacttttttttgtttgaggtaggatgataaagaaccgcagccagtgaagaagacagtgacaggaacagatgcagaccttcgtcgcctttccctgaaaaatgccaagcaacttctacgtaaatttggtgtgcctgaggaagaggtgagtgtggaagtggaaaatttagagtatactaggggctttgtatagagttggaattgctaggaggcagatgtaaagaactatctggggaactttattgtagggtatagtaagctaagtcttagatattgttttaggagttatctttctatgtaatctgctttggggtgatttttcttttttggtctaactgtgtacattggcttgtcctttgaaatccctgaatgatttgtgtgtgtgtgtgtgtgtgtgtgtgtgtgtgtgtgtgtgtatatttatatttgtgtgtggctatttgtctcgtagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaagtgggtcgttttagtgctgcagaaaatccaagctggaaagggggaggagttccaggcactatttcataataaagaggaggtcacctaaaagtttgactacctaggtagtcagatatctgacatgtcagggtagtatatgtttgtaatcccaccaccagattacctattcccttcaacccaacttggcaaaatttttgaacagaaggaaacgctagtcttgtgttctaggttccatgacaacttttatggcctacttgggcctaacaaatagcacaatggtagcaggtgacaggtagggcttttttctaaaggtttagttgtgagaggatgttaatacactattaaaaatgaccagtgtgctgatttatttatcaagttgtctccaggaattctgaaagagttactacaatttttcaaacttatcttgttgaccaaatgtctaggaaaactttgtaaagcttttctgttaagggccccatgtcttagtggatt

SEQ ID NO: 17164 - DNA, 1270 bp, Homo sapiens
ggagaattacttgaacccgggaggcagaggttgcagtgagtggaggtcacgccactgcactccagcctgggcgaaagagtgagattcagtctcaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattg

SEQ ID NO: 17165 - DNA, 1141 bp, Homo sapiens
atacagttgataaacttttttagacgcctttggcatttatgtttaaaacgacaccacctgctaagtaacaaacactcttcttaatcgcggtggcaaaaacgtatccgtcccgtgtgtgtttgtttttacccttccgctacactcttaagaaacttggccgcttccgccccagagagtgccctaaccacgagtcgggttgacagggctgctcgcatgcgcggtctccaccgtggtgtttgtcgcaatgggcgctgcgcggaggactacatggaatctcgactttgcagcttgaagtcattttgttggcggcgctggttaccggctacctccgcgcgggcacttgattgtaacagaaagtagttccggcccatgttgtttcggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacaggtaccggtgtcccgttctaccttggcagatgcccccttggggtctcgcgccgtcctctaccttgtatcactccttccctcccttccctcgaaccatccccattacatcagtgacattgctaagcttttcgtggtctactggcatctgatcacatcgggttttccgctgttgtccgcttcccgaacatttcctcctcctcccttgcttgctttttgctgcctttcttgctttgtttttatttcgtaaatgttctagcattccactctctccaggcgcttttatcacacgtgcgcgcttagaatgtcgtggaatggactgcattggaatccctgccctttcactcctttgcagcggttttctcccctaattccagctcatcgcctctcctttttcccctccatctcctccttcatctccccccccagtcttttccccttagccagatttggtccttctctgccaatctagggcgggggtgccgttccgatgtaatcatatcctcactttg

SEQ ID NO: 17166 - DNA, 1088 bp, Homo sapiens
gcacttcgggaggccgagatcagaggattgcttgagcttagggtttcgagaccagcctaggcaacatgacgaaaccctgtctctacaagaaatacaaaaattagccgggcatggtggcacacacctgtagtcccagctccttgggaggccgaggtgggaggatcgattgagtcctgggaggttgaggctgcagtgggccatgattgtgccacagcactccagcctgggcaacagagcacgagactctgtctcaaaaaaatcacaaaaaccaaaaaacagcaaaaaaggaaagtcttttgtacaagtattgagatggtatattggtttactttagagttttggttgagggtaagaataccaaaaaatatcaattttctgtagcattaccagccattaggcttaattaaacaattattagaacagtatcagtggaggctttatgattctgtacagtttttgaagactttgttttgttttctaggttgctgaagcagaagattgttataatacagctctccgtctgtgtcccacccatgcagactctctgaataacctagccaatatcaaacgagaacagggaaacattgaagaggcagttcgcttgtatcgtaaagcattagaagtatgtgagggtggtgtagctgggcatttagcatgatagtagagggaaagcagttaagtttaccatcatccacctcttttgtaaaaatagtggttgaatcatttacaagaggattattcattgaagtaacaattgagtacctaaggtatgatgtgaggccctatgtgacattccagaaaatccctgcattcagagttcattattctgtggataagatctgtacaaaaaaattaaacattaacccacagttcaagagaagttacttataagtatataatcttagtgcctgatggctgtatggtagtggttagtagatgtggtaggagtttagcagagagagatttcagtggtgttggagtggtcaggataaactaagaggagaagaggtgtacctcattatgtttgaaacaagaagaggtataaaatagaggaagaggtagaatttgagaatgaatagacttggaaa

SEQ ID NO: 17167 - DNA, 2602 bp, Homo sapiens
agatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaatacggctgatgtattttgtatcctgttatattgagtgttggactgaagaatagtgtcatccaatgatgaaacctatatttaaacacctccaaacagcatgaaaggaccaaatttccctactgtagctatgatattaggaattgttttctcagccaggtctggtagagggtggggttagtttatgatccattaagaaggcaaagtggccttgtgtggtggctcacgcctgtaaccccagcactttgggaggcggaggcaggtggatcacttgaggtcaggagttcaagaccagcctggctaacatggtgaaaccctgtctctactaaaaatacaaaaaaactagccgggagtggtggcacacgcttgtaatcccaactacatgcgaggctgagacaggagaatcgcttgaacccgggaggcagaggttgcagtgagctgagatcgtgccattgcattccagcctggacaacagagtgagatgtcatctcaaaaaaaaaaaaagacaaagcctgtgatccccaacacacccattcatgcttgctcctcttttgcttgtgacctctctgctttcatttacccttgtagtctcggttttcatgtggaccattc

SEQ ID NO: 17168 - DNA, 1176 bp, Homo sapiens
caatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttga

SEQ ID NO: 17169 - DNA, 1102 bp, Homo sapiens
atatgcaaatttggactttcaatatgagtcaattatgactaagtcaagtaaataaatcaaagccccaggtagttgtagaaaacacttcctcagactccacaggctcccctctgagattcaaataggttccactctcacccactgggtgggagtcactagtttagatcactcccagctccttcatttggagaaatgatatacagtgtttaaaacaagagaatgctcgggccacctgttataatgacaaagacatgacagaatagggacccacgctgatcttcaccactcactccaccttgggcaaatcattaagcttctgaacttcatattcctcctctgcaaaatggaggtattaaaaatctccaccctgctgccctcacagagttgctttcaccatcaaatgaaataacatatgagaatgtgctttgtcctatctactgtggtcaaagtcattccttttggttttttatgtctagggagttctgtggaaccaggcaccgaagaaaaaagtttaatcagtgataaaacagctgaatggattgcagaggatgatgatgacgtgtttgtggcttcacgcacaactgaagatttatttactgtgatacacaggtctgcaccaatttccttaattctaattgcaattgccttccctttttgtacttaaagaaaacctgctattccacattgaaatcctaattgtaaaagaaaaagaaaaaaattaaaaataagaaaaactgctacctttaagcagccattagaattgcacctggaggctaagttcagatacccacatatgtgagcgcagtccagggcctcgcatctcaaattcactgacatcgttgggtaaagtggaggaagggaggggagaggaggaccaggtgccgagtgagaggcccctcgtctcctagcaaccacttggcctattgtggctccatctgctctctcttagctctgtctatagtcagagacatttaacccttcacagaattccttgtatcaaaaaaatcccatcaagagttgaagtggggcaccaggcagcatatcaaaacaggaacttaggaaaagaggaaccagatggggaccagttattggacagggttac

SEQ ID NO: 17170 - DNA, 1180 bp, Homo sapiens
ttttgcaacaggtagacgtcccaaataaacaaccaaactgtaaaatttctactaatcactaattaacagaacacaaagcatcttccccactcctaacactcaacctctctcctacctttgattatcataactccactctctctcccacccaggcacttaccacaatgtttgctgccttctgcacctacgctgctgagactggagaagagaggctgaaagcccctctcagaaaggcttgcagagaacccaccactactacaattactagtataaataataatgataataatttttgaaggtggaatagagaagagatttgagtgaaatgaagttggccctaggagctcagcttccatttcaagtcgtccctatcctcttttttcctccccattccagttagtagcaacagatggctctgctagcctgactttgatctagtcaccatccccaggagcggaggttaattgttaaccaaggatgctttgcatttggtgggtagtcagtacatgtttttgagggtagttattcttggtacaatagcaagctttgctggtgtctcctctccttatcctgtactacttggcctgcctcagctcctgactgggcctcccccaccagccccaacttattcctcagccccaacttatccctcagccccaaatcccatgaactgcatccctagcacaacaactcacccataaaggaagtgagacaacaggaagcaaaataattaatgttagcttaatgaccacaaactgaccagttgatctggataaattaccttgaacgtgcaaagacagaggagatcctaccaggctctcctaacaagcactgcacctgacatccagtgtaactatctggacaacacagacccgattgcagtctctctgtacctgtcagtctgagcagatctgtccacgcacctgccctcttcctcatcaatgaacaagttgggaaaaagatgagttcatgctcagtgctctgttcctcactcgttccaccttccattatcaagtctgtgacacaatggtgagctttcgctttaatatgatttgctagggccaggactagggtgaggtgagcgaggcacctagggcgtaaaattcaaagaggtgcccgctctcagggccatgcaagtgccttaccctcgtcccagccctgtgatttgcactctttaaag

SEQ ID NO: 17171 - DNA, 1229 bp, Homo sapiens
acctctctcatttcacacatgaggaagctgaggcccagaaaggtcaaataacttatatacaaggtcacacagtgagtcagtggtggggcccagcctcaattccaggtctcctgcccttgggcccaatctggtttcatttaaagcactacaatttatagaagacccacagctggcttctacttttatgacacatgaatttcccaggtatttcaatgaactaatatatatgctttaagggaaaatgttcaagagttctttaattcattaatccaaagacaaattggattttcagtttataaacattagtttccctccaaattcaatatgtgcaccctacttagtacaatggatgttttccctaaaagttgtgtgaaaaatgagttttttagatatcaagtatcattttttagaggtaaacttcctatgtaagggaaccttctggtgacttctttttgaaaaaccgagattcctcttgtcattgtcccataatgtctctactttttttagtgcaaacttttgtatttggtgtttatttaaaagtagggtacaacccaaccaatattagctttcccagagtctactttagccttcccttcttaatctttatgagaaattttcagactgttaaatgctcatgagatatttagttgtgttctagaaatttcacctggcttgatattctgtcaatccctgggctcaaattccagctccatcttatcaaacaataacagaattccctaatcagtactaagctccgcatgcagtctcttttccagaacattctttgcctaatgttccttagtgtggctctctctttagttggggcctccttccttagtacatgcataccttactattctgtggaattgcaagccatgcatcttttagagccacactagtcaaattgattggcatttccatttattttccattgttcccttgtttctcctggacttcctctcgtttctcttttcgaggatgcttagaggcttctcaccagagattggtgaggtttcccccatcatctagatgggagattgacaaattctgtaaaggttaagacagtaactattttaggctttgtgggctacatgtggtctctgtagcacattcttctttgttgttgctgtttgttcattcgtttgttttgcaacctttggataatgtaaaccactctctttttttttgacagagtctctctctgtagccaggctggagggcaattgtac

SEQ ID NO: 17172 - DNA, 1611 bp, Homo sapiens
gaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaagtgttttccatccactttgtttcactgagatgatactggcagatcttaagatatgcttgtgaacatgctgtttcatgctttcagcttaatacaggttgagcatccctaatccaatccaaaatggggaaaatttctgagtgctgacatgatgccacaagtgaggaaagttccatacctgatgtcatgtgacatgtcacagtcaaaatgaaggtgtataacacactgtttactcagcatccccaagagaaaagagattctgttagaccccttcagctactatatatcctttccacacaggcccagattctcccatgcaagcctgcctacaaagggtaataaaatggttcaacatacacaaactttgtttcatgcacaaaatcgttaaaagtaattataaaattaccttcagactatgtatataatgtgtgtatgaaacataaatggatttcatgtttagacttggatcccatctccaaaatatctcattatgtgtatggaaattctccacaatcaagaacacttctggtccccagcatttt

SEQ ID NO: 17173 - DNA, 1178 bp, Homo sapiens
aagcatctgaagcgggtggcagctccaaagcattggatgctggataaattgaccggtgtgtttgtaagtatcttatataaatatttccgtggccactgtttttaagtgtctcccaggactcatttggggaccaggctaggggaggaatatctattcttggcttcctctgcccttgaaggagctatactatctagctgtcctccacttccaatcgatttaatatttttgtgcctcatttattccacataccacatagtacatttacatggactcaggattcatgttcttaatgatcctggtcctctgacagggaagatgctataaaactttaaggtatgaaatagttttggatgctttttacacctcctgtgtaaaagtccaagttgggtgtaatatggacggtcttggtgttcagttagtggatctggtggactaggaggtaggtttgagtgctttagtgaatcccaacagtgattatcatttttaacgttacaggctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatgggtaagaagttttaaatactctggagacgcatattgatggcagccctatggtatccaaatactgtcttgatcatttttctaacctttgtaatctgtcaagtctcagaaacaaagcctgaccttccctctgttttttacttaaataaaaaacatgcaaataatcatgaaacgcttttcaaaactaaatttcgattcacttttaaattttacatgcagtcatggggttttgaaatattgaagatctggccgtgatctttaatcttcagaatccttgttggattagaactgggaggcacatgggggttctttttgtttcgtagagagctatggttgttgctcggcatgaggtagtggggatcactgtatgtagtaaccggttactgcttgatttcagatgtcatcagcattgacaagacgggagagaatttccgtctgatctatgacaccaagggtcgctttgctgtacatcgtattacacctgaggaggccaaggtgagtgtggc

SEQ ID NO: 17174 - DNA, 1164 bp, Homo sapiens
atgaaaagaaatgaactataaaattgcatcacagaatttactgtgtaaacttttcaaaccatttgtgccattaaatagcgcccccaccaaaaaaaaaaaaaaaaaaaaaaagcctatccttaggataggcagctgatgtagctggatggtgggggctctaggtggccacgttctatctgtgtttatatggttaaatggatgaaatggatgtgtttgcagattgaaacaattcataaagagttgaggctacttttttttttttttttttttggtcttagcgctgaaactaaaaatcgcggttattttagtgtttagccccggctcttccgttgctcaaacctccggaaactacatctcccagcatgctgtgaaactggtctgacttcatctcaaatggccccgtagggcaacaaggatggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggtaagggaagtcgggatgaaagaccatgggctttgggggtgggggtgggggcggtggacgaaagagcgttaggaagcggagaggacactgggctgggggaaatcttcagaaatttcgagtagctgtatcagatacctaaagctgtatcagaaggaagtgttctcatatcgtttctgagagcgcagcatgtctcttcgggacgtccaatggacaggtaggagtgggggagggggtacggaggaggggagaggacgcagtttccactcataggggaccgctgaagtcgtgggaaaacaagctgcagggggaaggtgttccat

SEQ ID NO: 17175 - DNA, 2854 bp, Homo sapiens
ggtgttggggaggaggttctgaattatgctaatcaggactttacttagtaagattggtaatttttcctttcccctatgttcttctacccttaaaaaccaaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttcacatgtgtttttgtgattggagtttatttcatggctttattctacatactctgcttaattatacagtacagtcaaagctcattcattgggttgaagtagaataatattaatatattaatacatatataatatattatacatttcataatatgttagataatatatgtaaagaaatgcagtttaatcattcaaatacatacccactcaaacaaggcttactaaattcaagcgggcttattgacatctgtagggaacattttcttttcttttcttttcttttcttttcttttcttttcttttcttttcttttcttttcttttctttttttttttttttaagacggagtcttgctctatcgcccaggctggagtgcagtggggtgatctcgg

SEQ ID NO: 17176 - DNA, 1146 bp, Homo sapiens
tcagaagtagaggagctgagccttccctatcctgcttcttagcagctgtgttttctcttgactttattcttaagtagttgctaatggagcaacaggactgtgggtggtataataatgttagaatattccttatctgtgagtaactggttaagaatcaggatagggaagtattgagagcagaattaagacaagggatgattttcagaaattgctggttttctaagttctaactattgaataatgtctagattttcttgtgaatggtcctcttctacataaatcttttgaaactaaagctattagttttacaatgctaaggtatttactaacctacttaaaatagataaagaatgttcttttctattttgtcaaacatattcaaaagtgatatcatgtgtgttgataagatattggggtaaagggagaagaaatacatccttttatataaacttaacttcttttctcttagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcaggtatgtccctatgtacctttgttttctttaaggctgtgactttaaggataaattgtgcctttgggggccttaagtatgacctgtgtctgtgatttcaagaaacctttaagttttctgagttgtctttatagtttcttttaaaagtgttaaagcttctacagccgttcctggtagcaatgcagggtggtacacccactttagaaaacagtttggcagtttcttataaatttaatcatacacctgccttataacccaactatgtcatcctagaaatctaccctacagaaatgaaaacttatgctcacaaaaaaatctgcacacaaatgtttacagcagctttattcataattgccaaaaactggaaaaaaccttcaacagaggaagggataaacaaattacactatattcatgcagtagaatactgctcaacaataaaaagatacaaggtaccaacttgatcagatttaatcatggtgtataatctttttgatgtgctgttggatttgttttgacagtattttgttgaggat

SEQ ID NO: 17177 - DNA, 1161 bp, Homo sapiens
acctctcccctccccaggtccccgatctaaaatcaaagagattgatttaggatgggtgggtgccttgtcttctctcattgttcgacattttagttacgttttctctgagctctctggaaagcataaaagtataatatctgttaaaagttggatgaatgaactaatgaacgcaatgggattccagaaaactctgcgggagatgggctagaggacgaggaggaggtggatgaatcagccatgttagagagcctgggaaggtgagcagagttgaaaacttgatagatctaataatttactggctctgggtttgtcagtcactacattgcagcaaatgagattagagcatagttgtgggagggaaggaggtgacgcagcaatctatttgcacctagaaattttaggcaagtgatagctgcgtaatcatactgcggcaccgtttttttcttgcagcagtagctgcttgcggaggaggtctgcccactgcagctctctgcagtctccggctctctcctgcaggatcggtcaacgcagccgtcgccgccctctgcacccagcccaggtcgccactgcttcagtccggttctcaaagcctcagcaccatcttttatccccgagcagcctggatcgtcgttccctcagtccggacgccactgctaggtccgaccaccgccgcttctgatatttcggtgagtcttttcctgtggaggtttggtctcccgatctctgtggtagccaccttaggcgtgtacggtcctttgaaaaatggccgagtcagagaaccgcaaggagctgtcagaatccagtcaagaagaggctggtaatcagataatggtggaagggctcggggaacatctggagcgcggtgaagatgccgctgctgggcttggagacgatgggaagtgcggtgaagaagctgccgctgggcttggggaagaaggggaaaacggtgaagatactgctgctgggtccggggaagatgggaaaaaaggtggcgatactgatgaggactcagaggcagaccgtccaaaaggacttatcggttatgttttagatacagactttgttgaaagtctacctgtgaaagttaagtaccgtgtgttagcccttaaaaagcttcaaactagagcggccaatttagaatccaaattcctgagggaattt

SEQ ID NO: 17178 - DNA, 1817 bp, Homo sapiens
tgttttggttccatatgaactttaaatgtgctatacactccaattgaaagacacagactggcaaattggataaagagtcaagatgcattggtgtgctgtattcaggagacccatctcacgtgcagagacacacataggctcaaaataaagggatggaggaagatctaccaagcaaatggaaagcaaaaaaaagcaggggtggcaatcctagtctctgataaaacagactttaaaccaacaaagatcaaaagagacaaagaaggccattacacaatggtaaagggatcaattcaacaagaagagctaactaggttcctggcccacgccatcgggtctgagctgcgccaactgctctgagggttcgtggcccaccgctccttcatggttcctgctgccactgtccacgcttagcgctgtagagaagatggtgggtcggaacagtgccatcgccgccggtgcatgcgggaccctttttattgcgtactgcatctactttgaccacaaaagatgaagtgaccccaacttcaagaacaggcttcgagaatgaagaaagaaacagaagcttgccaaggagagagctgggctttccaagttacctgaccttaaagatgctgaagctgttcagaagttcttctttgaagaaatacagcttggtgaagagttactagctcaaggtgaatatgagaagggtgtagaccatctgacaaatgcaattgctgtgtgtggacagccacagcagttactgcaggtcttacagcaaactcttccaccaccagtgttccagatgcttctgactaagatcccaacaattagtcagagaattgtaagtactcacagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtccattttatttatttttcccagtgaaaagtgtaatttgatagagaacttttcattctataaatacactatgggttactaaaaaatcatggattttgtttattcctgaatcatagttaaacagtacatatgacatggctcatgttaaaaatacccagtgctcggttttgaaagataggcaaaaaaaaatgtataggagaaactgaagagtgtacatgtttttagggggcacattttgctgtaaatccagaaatttgatagacttgattgtgtttgtgaaaactgagcattaaacgttttgattgatcgtttctttccatttaatctctgagacataaatatgtgaggtgtgctgctgtgctgggttaacagcttccttccctttctgtgtatcagtcttgaaatgttctgtttaaatcagtatgcttaatgtgttctgggtatttatctccttgtattttaaatatatgtagttgtaaatagcaccaggagttagatctctgtacacccctaatctagccttgtgtgcttcgccagttaatgtgtgctcactttccctccatttgttacatgagagaatgcatctgctgatcactgaagtgtcccttttagcttctgattcattgggttctgttgggcatctttaaatctaccttaacctgaggaatgtatgtgggcaaccaggccctgcatttttttatattctgaaatttgcatgcttgcctgacttggtatttctgaattgatcttttttttaatggtataactatcttgattttcactgaaattatatggttctgtcac

SEQ ID NO: 17179 - DNA, 1112 bp, Homo sapiens
caagattcatctcagtgaagtgaacaatcatttcttcatagaaggtcaagcctttttaagccactcttaaaatttatgcctaatttgaaatccacagtccttgaccagtttaaaaaagagaggaaaaagaagacactattttatatgtgattataattgtttgcacaaacacttttccaccttcctctgtgccccattacctctgtgccactcagtcaccccaaatctctaacctttagtaatgtgtatgcctgcaaatattatgtgtttgcctgctgcaaaattgaaggtgtatttttatagacaaggtagaagcctctgaaaatgtataccaaatgtcttgttttgtagctaaggtcgggaaaaattgtatctgaggtttatgttccagctaatgttatcaaatttatgcttcaaactgtgatattttaataccaaaatcgattttcagcataatacaaaatatctcattttcactgatagaaaattgcttttaagtgttgatccttagaaatcttatttttttctataaccttagaatttgatcatatgatggtcataggaactttttctgccatgtataaatcacacttggttttgctcaaagaacagcatgaagtggtgaattgtttccatgaaacaattattgagaatgggaatacagtatatctggaaatgacacagtataatacaagttacagtagcatttgtcacaaaaaccacttgtcagcatgtgtaaacttaattttaaagcctattctaatcactcgagtttattattttattgttcgctatgctggttgactcatcttagtttcttcaactacccaaaaaaataccaatttttttcctctcttgtatgactactttttcaaactgttttcctttgcagggggctgattagcaattgagtattttgtaatgtttgggcggggttgctttgttttcagtgaaattggttgcagtgaatgctaaaatgacacagcacactggtgattaattcctcccccatggagccttttttctgttatgcttaggatagaacatacttgtaattttccattaggttagtaacatacttttgtgaaagttgtttttagactgaagaaagt

SEQ ID NO: 17180 - DNA, 1627 bp, Homo sapiens
tgattataagtgctcaaatttattgaaattagattctcatgcctataaaagtatactttaaaaatattttgcaacaactgtcaaattatttgggttcctttaaatagcaaacaattgggaaattttccataaaaatgaataggttttattaatacctgttcatgtagtatgtggactaaaacaattgatatatatctgtatgtaaaaatgaatgatcttatcttgccccaaatttttcttacctgattctgagccagcctttttgttttgatggcaccctgtgagtatgttccattttctgtgaactttgtcaaattcatactatatgaggaaatgatctaatattgtgggctccaggcaggtcatcttaattgcatgtctgtctcttctgtaaaatgatgaggtggaacctagagctggacaaaaaattagagatcacttaacattctgtgattcaaggaattcttaggacatttttactctatagaatctcagaatgattattctcagatctactgtccttggtggaaactctcacagtgccttgcatgcagtaaaagtttgatttgccgactggctgacgtgttaattatcacacagactccaagaacctgatgcttgctagaccttagttccttggtgatgctaagagtaaatgtagttttcctaggaactgagcactgaggtctgtgtcctttgcctgtgtagaatctgtctatgcagttggtattcaggcaagaattttagctgtaacaacaatggaaatattggaggacccactttggcatttatgtaaagatttcatatcctatccaacatttactttagtgtctaatcaaattccataccctcaaaaagatctgttggaacaaattgataaaattaggtggaaaggaaagtggtatgggactcaaatacaagtcacttctggtttaattattggctctgctgcttaattcctctgtacctcacgtcctcattgtcgaagtggggacaataatctggacctacctcacaggggaattgaggatattttcatatattagtgtgctttgaagttgactgaaagatatactggatatcataattatataatttctaaatagatttctttaaatccatgctatgttttctttttcagtcaggtcctacagaatgactattgcacttggtctattgttttaatagtaaattttgttattaatctcctatgtgttaaacgtgggtaattgtattatgttaatacatacttagggaggaaaagcaggtggatgtaaatcagtgattcccaacttcagcagatgatagcagtggagggtatccttgagctttttgtaatatttcaaaaagtatattagaaattatacatttacccataatattcctgcttcacaagtcaattaagacattgaatttccattcattttgcctatattctctcaaaagctgtgaatggcagtatgtttttgattaataataaaataagaaatcctattatgtgcaacttattaaatacttgggaacatgggaaaagaataatgaagggattcttatggtgaaaatgttgggaaccacttttataaaggaactaagattatttgaccccctccacagattgcttacctag

SEQ ID NO: 17181 - DNA, 1176 bp, Homo sapiens
aatatcactggcctaatttatttaggtgtgtacatgttgctcatacatacacacacatataggattacaaatgtggaaaatgttataatgtcatattctagcattggactaaatatcaatttctgactcttaaagtagttctgtgtataaattcaacatgatgaatcaaggcaataatttctcaaatgttcttttatttctttgtttttatctcgactttttattttccattttttctagtacgcaaatagtgtaaaattgttttaatgcctggactttgaaacaagtaacaagtgtttgaaagtatataatctacgagcgaatttgccctccttggactaaccacatacaaatatgaatctggctgcaagaacaggatatccaggtaactagagagtgggcattgataaaaatatctggtggagaagcctaggatttcaactttttgtcagaggattcctgttgggacagctttaccagaaaagaataatagcggatatgttcatccaaactaagaactttcatgcatcttgcattgttacatagcctgtggaatgaattcattttttctcccttgagtccaggaatgacttccctggaaaaactcaatctatatacagctgtgccaaaatgaaggatacctgcctctccgaaactttcactgctgcttctgtcattgttcacttgtcagataaaattttattatctcaggatgcaaatttaaaataaagtgtaaatctatgttaatgaattgaattctgtgttttttttatgcatcttcctttcttcccttccctatatgtccatcattataaggcaattaatttaggcttccttttaaaaattgcattttatatctggcctttttccacatatactagtgttaacgttcaatcctgtaagtattttatgctataaacacatgcctcagagaagtgtgaattcagttccagacaaccaaaataagtcacacaaattttggggtttcccagtgcatataaaatttgtgtttacactataatgtagtctattaagtatgcaataacattatttcttaaaaaatgtacatatcttaatttaaaatattgtattgctaaaaaaatactagtgatcatctgagccttccatgagtcataatatttttgtttgtggggggtcttgcttcagtgttgatgg

SEQ ID NO: 17182 - DNA, 2225 bp, Homo sapiens
tgtaaagattatttcaaagctcactcttccatgatttcttctggctttcaatcctatctaagtatcaaggaaattaacttgtaaatatggtagttgtttactaaggatatgtactgctcttgcaaggaaataatgtccaaacaaagcttcacttattttttttaatataagcagatttcactgtttatggcgcttatgtaatacattttatctttttaaaaatttgtccgtgtaaaagtcaggattcctttatatttgtgagcctccttttctcctttcctaaggatgtaatctacagttttcagatctgcagggtagtcttgattggctaaaaacaaatcaattttcttcttggcataaagtgtttcattattataggggtgttcattttaaatagtttaaaaacaattgcagcacattctaagcataagagaaagttattgacaacaggtaccttcctaatctcccaagacgtacttactcatttgtgaagtattaaagtaagaggtaactcaagcagaatgctggctatgaatgtagatattgaagctattcataaacactggaaatagaattttaagcttttagccttcagtggaatgcacatattggacatgtgcatgtgaacacctttttcagtagcactcacggatttccattcgattgtatagaatgaatacaagtgttttagtggaatttgctacttaatttttaatcttgcgatgtccgtgattattacatgcttactagtgttgtggacattgaagacaaggtcattcgtaggtgtcagattacaatggagaacaaaaatcgttttccccccacccacatccaaacaccattctcgagggagcatttcttgcaaaacaccttacatttcattttctatctttgcactttttcttaagtacagaaaagttgtctttaagacctagtttgaacttcatgcagtaagaggaacaaggataaacaatgttgggagttcacattgttcagagcataaggaaaagtaccaaaacccaaattttcttgaatatttcagatgtttttaaaaactcacttctagtctgaaacatttgaattgttttaactctgagcagctgacaaagttgaggtttttttgttttgttttgttttgttttgtttttttgagacagagtcttacttggttgcccaggatgaagtgcaatggagcgatctcggctcactgcaacctctgcctcctgggttcaagcaattctcctgtctcagcctctcgagtagctgggattacaggcgcatgccaccacacctggctagtttttatatttttagtagagatggggacttcaccgtgttggccaggctggtcttgaactcctgacctcaagtgatgtgcctgcctcggcctccgaaaatgctgggattacaggcgtgagccaccatgtccagccaaagttgaggtttattagtactattagaaacaaaattgagcaagttaagttaaaagtttgctgactttgtatcaacactatagaagatgagccaccttgttaatttggaatatttgctctgaaaagaacatgttagttacaccttaatggtgttaatggaggtggggattgagaaaagtgttcacattagtgttggaatgtaggtaattgtacagtttataagacctttagcaccaggaaataaaatatgtgtgtgtacacacacagtttttaaaaacgattggaattcatccaaaccttaagattaggaaactgattggctgtaagtgttgcctcaagtaatgtgtcccccgccccataacatgtcttttctgtgccaagtatcctctcctagtgtcagtgtctcaaattatatttatgaagggttatcacataatatgctttgtatttaactacctgcttcccaggcgtccatgacatgaaatgggtgaagcatcagccatgactttcggtcagttcccaaaatacccaaatgatagggaggtaaagattgcaaaattcctcttaaaaggccatttttacagcttgctaaaatacagtggcaccttatggttgttaatattttttcttttaaagatggagaatgtttttattcttccccttttctcctttgttcttttgcgaacaaaaaaaattataatctgccttatttgattttttttttaagttttaccttacaggcttccctgtcacatgttttaccatattaagtacatagaagccatgtttgca

SEQ ID NO: 17183 - DNA, 1113 bp, Homo sapiens
atctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaatactgctttagaatcatatgtattagaaatcaaacca

SEQ ID NO: 17184 - DNA, 2380 bp, Homo sapiens
ctaatctgtgttgacacttcagaatttattaaaagatcttcccttacttttcagtaatttaattagtttctttaagcctgacataacgaggaggagcccaaacaacataatcaagttttaccttgggaggaaaaaaagttttacctgctagaaagaattaataaaatattgctatacattcacttagaaagttcttctcttttccagtatgaacttgctttcatttgtttggtagtaatcattcaatttgaaaacatatgcacctcatgaatggccacataactatgtaataaggttttatttctcagaaaaggtcctaatattttattggtttatagttttaagaaatttttcatgataatttgatatgggagagattaattttagtattgttgacattggtgggtggatagctgaacttatctaacttaggtgtccactcttgctatataaaggtaatttgataagtaacatgaaaccagtatttcgtagtctttgctgccagagtaagtgatgcaagatcttgcttttaaagctagagttaatactgagatgcataatcaactgaaaagtggattagtttttttttttttttccttttcaacatttcttactctgaaaccatagttgttactgctcttctgggggtggggtgagtacttttaataaaccagttgcattactggaaatgtggttaaagtctcaatagaaattttgcttctttgttaattccctctatacatttccagtgatgctgatggaaaagattttgcttagccgcataaacaaacacataatactgaagtaaccatcagcaataattcattttgaggtgtgaatagtgttcaaagtaagttattttgtgatatgggaaacctttagtccaagaaggttaggaatgtttccaaggtgtggataattttcccactaagagatacaaagctatttttttttcgtatgattgtaagtggtccctacgccattgtcgtcattaaccattattttcaactaacaaaatcttaaattacttgaaaagcagttattgtagggtccataactaagtcttaaaggcatttcttttaaccacttcatattaaggtagttctatacagggaaataatagacaaattaagatgaaagaaaagcttcctaggatgattcattcagaggaaatgccaagaaaaagggcatttaattatagggtactaattttacattataatattatgtactcacacaaaaggataaagtgtataaatttctaaatcagtgttgcaacataatgttttttaatatattgagatgaatcaggtacagttttagaatatggaatctgaaaatggagcaagatgatagggttttattttttatgtctctttattttaaagattgaaaattttactttcttcctaagggacttccagtttacaaaaattaagttgaaaccaaggtaatttgggattgtaaaaactgggccagatgccttactgaaggttcttaacatagaaatatcttggtgagcagatgggctcatttggaaatttttaacagctcaagtctgagggtcacttttgaaaatcagaaagagaccttagcatttggacatgaacaagctcaagataagccttatgtttttcctctacagagatttgcaccttttataaaccttaagataaatattgtgtcattcctttggatgttgacaaagtagtttgtgaagatggctgtttttaaaaaagtttttgctttaaaggcaagatatttaaagattgtatgattccttatttctggatctctttgtccatactgccatcttgctcttatccttcctacttgctgaatgtgttgctgagtagcaacttttgccagtgtatattcacaattctcttaccttgtatctttagtactagatagtctgtcctggattaatagttgaaagcatttaaatatgtttgcaattgcagttttcttaaattgtaaacaaatccctttgaatatatagatttttaatgtaaattttatagtaaatgataataccaaatcaaatagattaaaactggtcagttaagacaaaataactcagtcagagaggcccttaacctcactgttattgtttatagcaatctatgtagataaacattactaaataacattatatttgtgacaagaaatgggtatcccattgaagcaactcttctctgcagtgtccagggaaaactgatattttgtcattcacatactgagaataaatacagataattaagagacactccgagggtatgaccttacagccttatgcagaaggtaaaaacttggaattgtttctaagtaattgtgaagctcataatgtgggtaaaatggcagcaaattatagtgtgct

SEQ ID NO: 17185 - DNA, 1171 bp, Homo sapiens
atatttccatttaacaaatagttactgaatgcctcttatgtgttctaagtgctttcacaggggagggtggtaaaaaaagattactttctgatccctgctatcccagaattttatactgtaccgagagaatttaagtatgcaggtgactaaataagaaggcataatgttgtgagggtagtgggaattgtcaattcagagtctcaggggaaggctttgtgaaggaagtgtcattgaagattttgttttaggtcgggttgcaattagataagcattcagtaaatattcgttgggtgaattttgtggacttttcaaatacaattcattatggaaaactgcagggatatcatagtccaatatattgagtcaatttttaaaatggaatctacagtacaaaattgtattcatacatgaagtctgatgaaaagtatactaatcacttaagagaataaattctaattatacttgcctatagttatttttatatattttgtagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtaatgagtctgtggctatcacatttacaggctgttcaacttttataaataaagattaatgaaaggaatgtgcatgcttatcttaattataaaggatgttaaagtgctttcacatccttggagtacttttctctgtatcagaatgtatttacttgatggtttgataatggttttttaacttccttttgtttagcactgcctcactcactgattgggattactgtttggaactacctgttcttttaagaacaacttttttttttagtatctagcttttctaatttctcttgcagacctgtaaagcaatgtaattgatttagtgtttagttcaaagcactaaactgcactcttttttttaagaattaccaggaaccttttaatctttctcctcctttttttagttgcaaaacacttcaaaagtaaatgtctgtccctcctttctggaaaccctccccacccccactcagttagtattcattcattcactgtgacctaaatatgtg

SEQ ID NO: 17186 - DNA, 1073 bp, Homo sapiens
cttacaaaacataaattttaataatattctaatgcaaattactgaaccctcagtgcattaaaattatttcctaatttatgagcctcttagtttggaggttgcttgaagccacaaataaaactcaaatgagagtcagttctttgtcccactgtagtttgcattttgtttagtttggttttagctctactaaggtttcacatatgtggctattgccacattcctctactgttttctttctgatactggacatgctagtaacttggagaggagaataaaagaatgtctcctggaattttacattcccattaatgtcctcattcagttggcagacctaggatgtatggttaactctcaggccattatgtttttcatggctcatttcccaaactgcattgttggtaggtgccttgctaagctgtaatgcagtgaagaagatggtggggcatttttagtaattggaactgtaacattaatttacaagattgaaccggggatgtctggatgctgacaagggagagccaagtactgttaatgccatcaatcctctaggaaggaattggtggtttttctgaagtgtgggggaaagggtggtttcttgctggatttcatggccagtaagtaaatttaaatgcttcatttttaatttggatgtttctgctagagacctttgatttggaaattagttattttgcatgtttgtcaactgtatatgtatgaaaatagaaaaaaaccatgctttttgtaaaaacccctaagatttgtatatgttcatctttaggcttctgaaagggagagaaatcatattggaaatcagtgttggtgttctgaaatctgcttgtaaaactctcatctcattttacattgatattaaaacattttaacagtgttggctagctgattacttgattaattatactcccatggccccataggaagctgttgtgggcctctgttcaaaagcacagaaaagagcagaaggaaatgtcttagaaagaatcaaagctgatgaaatcagcaaagattgggggaaaggaaggaagcctggtgtagattggattatatttttcctttgg

SEQ ID NO: 17187 - DNA, 1864 bp, Homo sapiens
gctccctggcttcagcctcctttccaggggagtgaacggttttgtctcactggcgttccaggtgccactggggtttgaaaaaatattcctgcagctagcttggtatctgcccaaaaggtattccagttttgtgcttgaaaccaggtccctggtagcataggcaccatagggactctcctggtctgcaggttgcgaagaccatgtgaaaagcatagtatcttggcctgagtgtcctcagggcacagtccctcatggcttcccttggctaggggagggagttccccatccctttcccttcccaggtgaggcaacgccccaccttgcttcagtttgcccaccgtgggctgcacccactgtctaaccagtcccaatgagatgagctgggtacctcagttggaaatgcagaaatcacctgccttctgtgttgatctcgcttagagctgcagaccggagctgttcttatttggccatcttgccagccaccgtctaatggcttttcagagtacgtgcttcagttatctccacatgtatataaaagtttattcattacctcatagacacactgaacttgactgctgaaactggttagaagaaaccacaatgtttatagtacatacagtaaatacaaggctaaccacagcatgatgatgcaagaaaggatttaccaaagcagagaaggggaaaatgaggctttttttattccagtggacacagggaaaaaataaaattaaaactaattgacaagttatgccctaggcaagagctgaactgtagatgcatacatctagcagcaacaattgtgcacaaagcaaataggtttctccatgaattgtctttggcaaattcttagaaatatttaaaacatttgttacagtcttcgttttataaaaatgtcatttttaaaaggggtaagagaatgttaaatacttcatactagacagactttgttattaagaacttttactgtattaactttttctagttcatatcttattaaatattaacaaaagtgcattcatatacattgcctcaggctgaggaagaataaagattattggccacatacaattgtgcccctgatggccttttccaggtagctcaccagtaagaaaatgtgcttaatgacttctctctgattggttttagagaataagaaacatgcagttgaaagtcagagtactttaaagcaagaggcatctgtccaaagactggttgatgaaatctggggaaagggagggaaatacaaagaatactgtggctgccctataagggaacaggaattcaaggcagtatccaaagttagaggtaaaggagcgggcagaatggtgctctggtgcggtaagcaattcttaagatggacttaaggtaaccaccacttggcatacatgtcctttataattcccatctgtttcagtgtgggcatgacttgtgaatatgaagaaattttattcctgtgattaagttactgatcattttattttgagttaatcaaaggggagattatcctgagtggatcttgcctaatcaagtgagctcttagacaagtggccacagcagatgttctcatgttggccttgaggaagcaaacagccatgttgtgagaggagggtactttgtggtaaggacatgagagtggctttctaggacctgagattgttccctgtccgacagcaagaaaacaggatttcactcttaagttgcaagtaattgaattctgccaacaaccagtgagcttgtagaagacctcaagcctcagatgagattgataccatgacttcagccctgtgagatcctgaacagaggactcagttaaactgtacctggactcctgacccataggactgtgcgataataaatgggtgtt

SEQ ID NO: 17188 - DNA, 1155 bp, Homo sapiens
aatttactttctgttctgttgtaatcaacagcagagtaagaaagatagaaaaggcaaaaaaggcacaagaagagattggttctcagttggagaaataggacattatctctctcactgtgaggcccaatctttccttaataactttggagtcaagttaaaaagtggctgcctggttatagggaatgtatccggtgaggagcaagcttcaccaatgggagcttaaatttaatgattcattgccatagtaaagaatggaaaagtggtttccttactaataaatcctgcacagttattgtgagaagtggaaatgactcacagagatttttaaccccaatctgcatacaacttgttgatgtggatttttttcttttttcgtgtgtgtgtgtgtgtgtgtgtgtgtgtgtgtgtgtttgtgtgtgtgtgtggtaagaacacaatctattttctcagcaatttttaagaatacaatacattgttattaactatagtcaccacattgtacagtagatttcacaaacttattcctcctgactgaattttatatccatagagcaacgtctccccaatctccctccccgcttcagcccctggcaatcaccattctactttctacttctatgcattcaactgatgaaaaatttaaggcttatagggctgttcatcttgccttagtcctcataccattaggctggtcaaactgtcaatataaatcattagctaaggcaaaagatttcctccaccagctgggtttaaatgggcttatcagataacagatggcatgaagcatgaggtcatggcaaatctggaggaggctgaattgagtcctgagtccattcagttgtttttttgtttgtttgttttttggtgagggtgcttctgacaagtataagctctctttactggcaatcatggctaatactgaaacaattcaacaggcaatggatgccctgaatttgatagaaactcatgaaaggcaaactcagagtcaactgttgcctgttaattctccaaacagtaccccaattggcctaaatcaaaatttctgtaaacagtgtggttatctcactcttaggtcaaacaaaacaactgtagtcaggcctccacttaagcatgaacctcgagatgaataaaagaggttatagagatccttaagga

SEQ ID NO: 17189 - DNA, 3105 bp, Homo sapiens
cattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttactttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtgttgtgctctttattgtattttcacagctttgaaaatctgtgcacatactgtttcatagaaaatgtatagcttttgttgtcctatataatggtggttcttttgcacatttagttatttaatattgagaggtcacgaagtttggttattgaatctgttatatactaaattctgtaaagggagatctctcatctcaaaaagaatttacataccaggaagtccatgtgtgtttgtgttagttttggatgtctttgtgtaatccagccccatttcctgtttcccaacagctgtaacactcattttaagtcaagcagggctaccaacccacacttgatagaaaagctgcttaccattcagaagcttccttattacctggcctccaaatgagctgaatattttgta

SEQ ID NO: 17190 - DNA, 1216 bp, Homo sapiens
acacaccacatttgaaatggaaacgtacactgaaatttgcagctaccccatagaataatttttggcacatagtaggcattcagtaaagatttgttcagtgaatgaataaaggcattctttatctctcatttttatttgatcattatcaagttgttgataaggagaaaaacgtggccatttacagatataacttaaaacatgcctcatgagcgaaatgtaagtttaatcatattcttttgacagttttaaggattctaatcaaggaaacccttttaagaaattctcatgtagatgaaataggctttaaaaatacctgtgctcatcactatctatttgaatgaaatctgtggttaatttatttataatgtaatgactccttgattaagaaaagtatataatgtattttgctatacaaatagaatatatataacccacttttaaatgatgagcaaggtggaaaatctgttcttaccagtaagcagagcgatatatcaaattccttttgtgttcttttgttaaattttcaggtgaggggaagtggcttcgaaacattgactattaccgtttagatggttccactactgcacagtcaaggaagaagtgggctgaagaatttaatgatgaaactaatgtgaggtaggaaaaattttctgtatatgtagaaacattaaaataattaattttaaaatttacataaagttcactatttttattgtgtatttgaatgtttttagcaaatgcaaggtacagtcaggttgcaaaacagtgtcatcactccctaaccactgaattcacttatggaatcatataatttgtagccttttgagtctcacttctttcacttagtgagatttatttgagaatcatttacattgttgcatataccaataatttttaaaaattgttgtatagtcttccattatagggctatatcacagtttgttcagctacttccacttgagggacatttgagttgtttccaggttttggaattaaaatcaaagctgctctaagctttcatgttcaagtttttgtgtgaacataagtatttacttaaatgaaacaaaagcctaggattgtgattgctgggtcatatagtaagtgtacatttatctttgtaagaaactatcaagcagttttccaaagtgactgtacaatttttcattcccacccgcagttgtatgagagttccagtttccttacattcttgtctgta

SEQ ID NO: 17191 - DNA, 1148 bp, Homo sapiens
tggccgtttattgtttaagcaaaacaaagctataatattgtaagattgcttaatttattaaatttttttgtggatatttaaacgaaggtgacaatctgttttcttataggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtaacttattttaaatgttttctattattaaaatagtcacatgaaattcatatagtaaactatttttaattttttttaatttttaatgttttttaaccagtgatgcatatttcagtgggaatatttaatattcacatgtttttagtagctacttaaaaaaatctttatttccccacaaaaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggtaaggtattaatagacagtgacataaagaagcaagttgaataaaaaatgtgtttatattttaacaaatagtaattgcacagctactaagtatctggtctttgttgtggttatccttcaggtttttgccttttagaaaattcttagtatttcaatagaataaaatcacccttaatgtcgccagctgttcagaatttatttgctgagtctgaaagtgtttagggttttaggggataccttgtaaacacttaaaaatgcatcaaatgcctgtgttgcaatcaaagattcttccagctatccaaatattaggtgataacaagagctctctccatatcctgaaaacagtttgtgtctttccaaacttcatgtcattagaagaattgctgcttgcttatctccttttaaggggccatcagtatgaaaggttaatattttcaatactgttgatccttatgtgatagtaatctgatgtgagagccagatgttgatatatttgccacttggaaaagcaacacgttgtactgtctgcaaaac

SEQ ID NO: 17192 - DNA, 1442 bp, Homo sapiens
aatattccattgtaagtgtgtgccacattttgttagcccagtcatctgttgatggacatttgggttgtttctacctttcggctattttgaataatactgctatgaatatgggtgtttacatatctgagtccctgtttttaattattctaggtatatatggaaaaatggaattgctacatcatatagtagttgtatgtttaacttttggaaaactccacactgtttttctctggtatctgtaacatttgacgttcccgttagcaatgtaccaagattccaatttgtctgcatctttgccaacacttcctttgtttctttctttttttctttttttctttttttttttttttttaacaagaaacatcctaatgagtgggaagtggcatttctttgtggttttgttttgtattttcctaatgactggtgatattcaacatcttttcatatgcttatatcttcttttgagaaatgtttattctagttggtagcccatttttaattgagttgtttgttttttttaataggtgttgaagagttgttttttttttttgagacagagtctcgctctgtcgcccaggctggagtctgatggcacgatctcggctccctgcgagctccgcctcctgggttcacaccatcttcctgcctcagcctcctgagtagctgggactacaggcgcacactgccatgcccggctaattttttttttttgtatttttagtagagacggggtttcaccgtgttagccaggatggtctctatctcctgaccttgtgatccacccgcctcggcctcccaaagtgctgggattataggtgtgagccaccgtgcccggccgaagagttgtttttttttttttaatactactctattgctgaatataattctaaaggttttcagcatgttttcttccaccttttcctgctgtgttaattaatggaatatgaaatggataaattaaatgactttgtactgtttacctctaattgtttaaattctgtagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtaactaatttctttcttcttctttttcttttgtagctacagggtcttgctctgttgcccaggctggcctcgaactcttgggctcaagtgatcctcctaccttggcctcctaaacttctgggattacaggcgtgagtcaacacacccagccttaatttatttctattaatgatttattttatttggtatatgacttcaa

SEQ ID NO: 17193 - DNA, 1260 bp, Homo sapiens
ttagagtttaaccagttttcaaataaaatagaaatacacggtatgagagcatttactttaataagacttaataggtttaaatgtcaacagtgtagcctatacagatatacttaagtaaggggtggctgggtgaagaaaaaaaaagacactatcagtgtagtgaagaataaggaaaacaacagtattaaagactatagctataatgtttcaacataacttttaaacacttcctggacaatagcataccccatgctcataatcttcaacaagaagacagcatggtatagtgcatggaattttggaataatgggcataagggtatctgatttctaacatttttaacaactgtctgtgtcatcatgggcaagtgactttactttttgtcaaaaatttactatatttaagaagaaaaagttgggcgaaattttctgtaattctagtaccaaaaaatccatgatagatttgagatgatttcattaaagagcactacattaaccattcatttattcctaatagtaagttctaacattaagaaaacataaaaatatacatgtaattttctgtcataattttgtaagaaattaactgacttagtaaatgccctgggttcagctgttagtttcgctcttttatatcttgctgatgctgttaggtttctctgtttcaaaggtcagcattctgctaattaacagaagaatgtttttattaaggtgaatgaacagttttattttacagttttgaatagagcttaattgtggacacaaatattcagattctgcttgcctacttttttaaattaaaaaatgtatatccatttattttatgggataggtggtaggttccagaatggagtgataagggcatacaatttattcatcagggattttacattatatcatcacagccagatactgaaagcatttaaaattttactcttttttaagatgctttaatttttcttcatttatatttgctatttgattttctatacatcatgaggcctcagatgttactcaaaggctaataatgttttaaacattctatatcttaatttaactgtgaatgatttactttaatttcatatttaaccaccaaataagagtgttgttaaggtataatttttttgtgtgtgttagagcttgtcaaaatataaatatcattttcaacttttaagttacctgatcgtatctctctgtaactggcaagtattttattggaaagtatctttaattccaccttgaatttgtgattaaaaaatac

SEQ ID NO: 17194 - DNA, 1595 bp, Homo sapiens
aagagtaagcagatgacctaaattaccactaaaattactggcagtaaaatttaaattgcattataacaaagagattaaaatgagttttgttgggaataatgtttatttttatttttttacatatcttttcagtttcctgaaagaagggaataatgttttaatctttaaaacatttcaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagtt

SEQ ID NO: 17195 - DNA, 1179 bp, Homo sapiens
ttttttgattgggttgtggtgcagttccaggtatttaggtatcttttctactccatatcctgaaggatatccttgggtttatttctaggcgaggggggacttaacacagggttttgcttccagaggaccctagtatactactttttgtgatgtccagccttaatgggacctcaagtgtttccccactttctgggcaaatttcgaggagtaattaggccctatctttatttacttatttattccatgaaggatgaagggcaggttaacgtgggctgatgcgaagtaagatttattgcaagggaaaatgcctggcaggcctcctcttaaccaatcaagcacgtttattaggttgaagctgtttttctgtgtgcttctgatttgcctcttgacgggtctgaaaatttgggtagtcaatatgaaatgtatacacttttacccaggtggctggctggcgtttcagtttgacatttgaattttcatcccacaatgtgaattaagtaatttttttactcggagatgcatccttggcgtccagtggcaaaataaaattacaaggagcatgggtcagaattgcatttcaagttggcgaaatgtgcctttgagtaactcttagattggcatatgtttttagagcaatttagctagaatgtagaattgggcaatgagcctatgatacgtatgtctgtatttctgcatgaacaagcagtagattatattttctttaccttggggaaagatatgcttcagttcttagattgtagatctctagttgtgtacacgattgtggccttggtttctgaatttgtcagtaggctcaaatacaacaaatctttatctgtggggtattaggcacgtaagtggtacccagtataacttgttggcctgtaattaccaggcactcatgttcatatgcatggatggtgtaccttacagttaaattatgacctctagattttactaagtttcacaaagtctacatttgaaactatagtttgaagtcggatcttctcagtttctttagaatgaacaaattacgtatatagaatttctgaatagaataattaattttacacaagggtcagtttttcttactagtcttggatttttgtagatcttgatgataagagtaataatcataactaagttgagtgcttattgtcgttctttataatcttgatg

SEQ ID NO: 17196 - DNA, 1619 bp, Homo sapiens
ggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaattctgagtttttgattaccatctaaagaggagtgagttttaaacactaaactagaattgtaaaattaggattttacattttgaagttataattaaattaatttaaatttcatattgtcctaaggacagtttgatgggacagtttctttaagtatttctggattgggatatattattctaggaatctatacatggtccctcattcttaatgttgttacccattaggtgagtcaaaacaaccaagatgag

SEQ ID NO: 17197 - DNA, 1131 bp, Homo sapiens
gtttcagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatccta

SEQ ID NO: 17198 - DNA, 1187 bp, Homo sapiens
aggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgaggtaattctgcacgtttgcccgcgtgctctctgtgctctgtcgcaaacctctttggccggagccgacttgttctctcgtctgctctaagttcttttagcttttggctgggccccaggggtcctaggcttggagggcgaggctgctcacgggtttggtggtttctagccgcattttccccagcccagaaagcacccgaagtcacccttcggggatggatcccactgaggaagggctgagattgccgctgggacccattttgtcctttttcctattggtgaaatgcagttccgttgcctccagctcccagtcggcgagatgggacttaatgcttatcctgcaaatctctaggcttcaaggaagggaccttgaaaggtcattttactttcccttcccccacgctcctagaccgtcgcagccaaatgagaaacggcccacatctcacaggttcctgcacaaaaggatatttttccaagaggatgttgatttaacttcaggagtagacccccccgccccccgccactaaagaattggggtgggagggtagggcggggcgaactggaggaggccctgcagagcttacgtaacaggcgtctgctgccctgcagcgcggtatcgttggactcttgggcacaggatttgcatcaggattgtgacatactaggtaatggtagagcagggtgtggctgctcatacttgctggcctccaatctcatccccacgtgtggctagaaaagtagaattttaaaattgggggaagtttcctcgtgcactttgggtctcttactctgcgcatgtggatctctagtcacttgccaacacggtttctctcttatctgccagaattgttggtagagtgggcagcttttacatttatcctttttgtcacgtgtgatatatttgtgcataccaggagcaaggtgcaggaggatgagtcggtatgtaactgatggacttgactgttcatataccttaacaggatcc

SEQ ID NO: 17199 - DNA, 1256 bp, Homo sapiens
tggagtggagaaagttagaaggtagtgttgtcattagcagtcattactacctgggcagtacagaggaacttcagataaagctcctggcatccactgaggcggggagggacagatagaaacttggtctgagagttatggtctagtagacctggaatccacaatgtaaaagttggccagctcctggccatatatcctaaaaaagagctggcatgttattgggaagataaagtgggggaaatctggcttactgggccctatagtaatgctgtctatgtatgtgtgctctctcaaaaacaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcaca

SEQ ID NO: 17200 - DNA, 1271 bp, Homo sapiens
acatttccttacaggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaaccactgtttcttttatttcatcacttgagatatagtcaatgtgaataattaatattacttatttagcttttggtgtacctgtaacagatctaaaattatgaggccaactttgcccccattcccacctacacatatttatatgttatattttcatatttcactcccttttgacagtatattaattactcttttataaacatcccataattggcttatcatgtaaattcaactatttatttagaggcttcaggcgcatagcactttaaaatcttttgaagtgttttctttctcatcaaattaaacaactatacacagctataatggatcactaaggactaaccttggataagatgttgatagcttttaagaacttcaaatgctgtgatcattactcatgtatctaagagtctaaacttcataccaaggggacatgagtactataaactatttcccttgtattagg

SEQ ID NO: 17201 - DNA, 1180 bp, Homo sapiens
ttggagttgcaccagccccgcccctcggaggcacccggccccgccccctcggtccaggagcagaaacaggaaatgggattgcaaacctagtagctgcgcgtgccggctattcaggactagcgcaggactctgggcgacctcacatcccactcgtgctgctgccccgggcactcgcctcccgcgaaaagtcgtgggaccacgtcgaatatggggagtatcctttcctgtttgaaaagctgctcttagggcatagggaaaggtggggagggcagaggttgggaccctgggaggtgcctggtagtgacctttttggtctagctgtggagggctgagagcgctggcaccgattggtgggctccagcagcttggttttagtttttctgttttttgtttttttttttcctgggactcgctgccatcctagaatcaggggaggtgggactgctttaaagaatggtcaggggagtcgccgcactggtttgagatttagagcgcgagccctcccactctgagagcttctgtcacctgtcctttagtgaattcgtcctctttgaaattgttgggaaactgtgcgagaacagaggcaaggcaacaggagtttgccagaggtttagggtgtaggtgtaggttttgagtgcagtactagggcagatagcttttgttgaacttcacttcttttcctgggtggaggtgaccggtaaggaggtaaagtgcttaacaccaagcctccaaactaagatgattgcttgcttaataataggatttaacacatgaggaaactcatatagttccctaaagctataaaattcatcaattgcacctgtgttcccacttaagaaatgaggtcagagtttagaaccaagctgtctaaagccctgaattaaaggatgaaattgtttttcacaacggaaatgttgtaattcctcttcttcaaggagttggtattatggaaaatagaatagcttggtatactgccactgaatgaaacttggcaaaataataaaatgtgagtaatagtagttgtttgatagctcatgttaaagctcttttagcttcattcgtttgtaagcctacaacatagaaagacatttggtgaaagaattatgtaagccatactgagaatattgttaacattatatcatgtgccggactggccgagaataaaatatgaacccttgat

SEQ ID NO: 17202 - DNA, 1169 bp, Homo sapiens
aaattgtgtaatagatcatttgaaaagtactgttttgttacccttgagtattattcatctaaaatattaataatgaagtgctggtagttctgaattatttccgtacgtttaatttataaattagattcagtattgtttataaaacaagtgtttttgtctagtctgaccctatagagcaaaaaatatgcccatgatatcctcatagtcatgaaattaccaagtaatccttttacttttgtagatttgtgttcatttttattctaaatgtggttagtcgttttcataagaaaaagaagttactaaaacaaaacagtagttgaaggttgtggtacatacatttttgctttccgtttttttcaaaaatttaagactgctgaacacaacgacaagtttttaacactaaaaataccttttataagtttgcttgtaagtattcaagcagaaattctcagagaattatctgagataatgagccacattctttctctaaacatgtgttggtatctccttcaaaaaagatgtttaccagtgggcagttgtagcctgttctcttcatattagtgataagaaatgacttaaaaaaaaaaaaagactagactgttgctacctagatttgttcacttttttattcattcattcagcatttactgagtgtcttctatgtgccaagcactataattttataaagagctttacagttcacaaagtccataatctcagtcatcagaatgacatcagttaatttcatttttcagatcagaaagatgagttttagtgaaatcaagtaatttgcctaagcctacatggctggtaactagaaaagccttgattcatccggcatatctgcttccaggtttctcgtcttaacttttatatcttattaataagatgttttgttctttctttcttcccaatctctatgaaatggagacttctaaatcatgcctgtgtatcttgaaaataacatttctttttgcttctggctcagatctttaataaagaggaccttgagatatggatcttcaaacatcttagtgctttggaatttttaaaactaccaggtttggaagtagaaaaatgattgaagctcaaatgattgaattgtatatcttacacactcttacaaaaaggcaaatgcccaagaaaagtgtagagaatttactcctatc

SEQ ID NO: 17203 - DNA, 2181 bp, Homo sapiens
atcaacttatagattctgctcatatcattccaaagggttcttctgttctagtctttcaggaaagaaccttattgcactgcacactcatgttgtgaatcattattttatagataaaaaacatctttaaaaacccttattgtcttgtttacagcagtagagtgcacatggttccataagtgagcttgagttccaaggtcagttttactccccaaatttaatattacagatttgttcatttgttagatacttacatttctgaggtaagagggataatagcaatttctgtttctgtaacagcaaatttgttgcacttagatcaggctcatgggataaaacagacttcttagtatatacctagctatcccaggatatttcttaagctaatgtgtttgtctcatgctttcaatcatttcatgcatctgaaaacccttaagtgcagaggaaggcgtacacacataaaactttgcttttttggtagggtcggcagtagggttattcttggactaacatctttaagcagttttcacttgcagtggaaatgatgttcaggctttaagagaaagtattgtgaattgttaatggcactaacttctgttactagacagcagaccaagctatttttttgttgtagtctttttttcactaaaccaaaactacttctggttgtaactcagctgccactttaaaccatagtagagattcaaaacgttcctatttgaaactacatttgatttttgctaaaatgtgctgtttcggttatttatctcttgggcatttagactaaattgtgcctgtattcctgaaatcaataatactttggcttatcctgatctaagtaacatagttacttaaattcctggatatacccaaatatggatcacatgtatcattttagtttgaaattttttgttgacattcttctatgaagagctgacctcttgaaatgtagaagaattgacatttgtgtgattttggctatctggagctttatttataatttattttgaaaaataaaaatgccacatttatttcccaaatgtcaagattttctagaattagataattagaataataaggctgaagacattttaaagcatattttatatgtagtgaaatactgtgaaaatattagtgaacagcattttgctgtaatgtttatttcagttattaagatttaaagagttagtcatcagggtatgttagataaacatagttatcatttattaaacaaacagataattttctgtttgcatgcaaattattttaataagtgtgaaaataaaagtttggaagatagtatttttacttttatatctggacttttttttcccccaatttacactttgctttcttgtaataccacctcctgtgaatgtgttgtaattagtatcacattgattactttatcattttaatttctttgaggccctttaaacctacgtaaaatctgggtccagccatagcaaagcaagtacaaaatgaacaaagaattttgaagaaaagcctaaatcttaaattgctaagaaaaaacactgttatatttaggcccgtgagagcatatacatgtataaacctaatcctatgctagatatgaatagtcagtgagctgtaatatttctcataaatgctaataatgtttaaattcccagctttaagatcttagtgtgtgtatatatttataaaatctgaattgtgtgtttcttctatggcttactgtgtgtttctctttcagcaataggatgctctctaaaacattcactagcctactagcctacttactaaatttttgtatatgtgtgtttgtgcacttgtatgtgtgtaaagttttttccccaacttgacacaccttatctcagacattcaaaaaaagagaacattttgtatggaggacagtctgccaactttttgcctctctacagctcttagcctgtatatttactgcttgatcattcattatgccttctagataaccagtccaggttttgtcatatacctgtgtccctctattctttttatttccctttttaattttttttcttttttttccctccccagaaatcaggcttgtgttggaattcttctctataatactttgtttcccgcagatgcaaagtaacaaagtaactgagtaaaattagaaatctcattctgcacaactgtgcgctcagatatttaactcag

SEQ ID NO: 17204 - DNA, 1203 bp, Homo sapiens
attatagcatagcatgagtgacctttactctagttcccaataagttcctgatctctatctgagaccacctcagcctagacttcattgttcatatggctattagcattttggtcaaaaccattaaacaagtctctaggaagttccagactttcctacatcttccttgatttacagcctgccttgaagatctgtaatataaatactagtatgaagagatttttaaagaaagctaaaagcaagatagaagaatcaactgcatttatgtacatatgtaatacaataagaagtgtgcctaatgatgatgctaattaattgaaaaaagttaaattatgcttggtagtatttatttaagatgtggtcatatgtaatttatttcagaaagatttctaccacttggaaatcaaaatacataaagaggttaaaatgtaaaataatcacttatcccgaaaacctagatggaagcttcttataatgctagatacagtacttctgttgtcaacaaaaagtagtaatttagagtgggaacagagctaatattctcaagagcatccttttaagaattttaaaacattataggtgatagattccgcagtataatagatgacgcctggtggtttgggactgtggagagtcagcagccttttcaaccagagtatcctgatagttctttccagtgttacagtgttcagtaagtatgtttatgatcttttatgcctaatatgacattgtagtagtatgtggacttttaatagcctccatcaggagtaatgcccttttatctgacttatctagtctcacaatacctgtacctgtaaagaagaaatttgatggtaaaatgctcagttcttcccttgttttagtcaaagcaaagttctttgttttctttgactaaaacaaaggaataactaaacactttattgctacctcttttgttgtttgcattttctattaactatttctactttagacaagaattgcaactattttttaatgggaaatatggaaactaatttactacttaaagtaattgttattgctggaatatagctatgaatattagtacttagtcttttgtttagtcgtatgaattctaggcagaggtggttgcatcatgtttggaagtactatttgttttcaacatctactttaattattcttgaaaatccagagttgtaagattgctaatgaatgaatcctctcaag

SEQ ID NO: 17205 - DNA, 1289 bp, Homo sapiens
atggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacgatgattgtgttttgttatatcttcaaaaatatagctagtgaaatattgtgcttaatttttttctattgtgttattcatgaaaatatttaatattcactgacataaaattaatataaagtaaaattcaccattttaattataataaaaataaagtatataattcaatggttgtcagtatattcacaatgttgtgtccactgtttaattccagagaatttttatcacccaaataagaaacaaagcaccaattagcagtctcttcccattttcgcccaacttatcccccacctccatcccttggcaaccactaatctgccttctatctctatggatttgcctattctgaa

SEQ ID NO: 17206 - DNA, 2381 bp, Homo sapiens
ctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcctatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataacttatgtgttcttggagtttatataatagtaattttagatgagtaatatctttttttagagggttgggaatgcaaaaagagaaaatagtagaaagaaaaagctttgaatgcaattcaaggttttcgttttctatgttttctttttagggcttttaatctcacaatacacatgaggtcaaatgaacaattttattgggtttacaaaaatacggcataaagaactctagagaaaacagggtgctttgtaatacactggaaacgcaaaaaaagttttttagtcaatattttctcctaagctttattaaatgttgctgatgatacttgcaatattttatgtggtcattttcacttttattttaatgtcaaataagttaacactgccaaaatgggcattctttaaaaatagatgtattttttgccatgtttatataacttaaaattaacatagtatattaaagtaaaaggttgaattgagtcttcctaaactgaaatattttattttgtcagctgagaaatatgttttgtagatacaaaaatgcaagtgaaattctgaatatgaaggtgagttttatttaaaaaaatctccaaaatatttggccggaaaatataatctttgccacttgttatattacattcagattgtttctgtttgtaaatcagacttgtttatttgttatgttcagttattgagctggtttgttcttgggaatatttgactctcaggaagattttcattttcaccaaacaatgcaaattggacgtcgattgcattgttaaatgtcaacatttctttgggagtctgagtgtaggggtaaacagaattttaaaacagaagttgttaattacttgcttgggaaagtttaaatacagaaaatgttggtgaagtcagatttcattgcacatattccattcattcagcaaaaggaaaaatgaggattcacatggattttattacccagttgtggatgctgaaaaatattgaaaggttgacattggtctaatctttttaatgtaaaatacatatttcttttcttttgaagaattccaacaaaactgattaagaaacatgcacatttgattaatttgaaccttctagtcttctgcttccacccatcattcttcccctgtatctattatcaccttcctttatttagcaaacaaaattttgaaatcctttgtaaagagtactataatgttaccataattcctattttcacacaattgtctttttaacatctttactgagatatacaattcacatactgtaaactttgctcatttaaagtgtataaggcagtgacttttactatattcacagaatcatgcaaccatcactaagatttaagtttagaatgtttcatcacccaac

SEQ ID NO: 17207 - DNA, 2146 bp, Homo sapiens
tgtaagatttgtggtgttcctaggccaaactggatgaagatgaaattaaatgtgtggcttttttcctattcttatcaaaggcatcgttgtctgctaaattacttgaatattaagtaatattaaatccccatttttaggggaagtgagatttaaaaaaccattcacaggtccacaatattcatactatgtgtttgcagtagtgttcaagtgtttatttaagcatataattggtgtccaccaggtcctcacaacttctctgcacacaagcttctaaaattcctttcaaataaagttactttaatattttttttcttgtttcatacaattatggtttggggagtcattaccaacaatcagtatacatatataatagtataatgacaagcaatgttagtatttttaaacatcagatcctgaaggataggctttttctaatgaaagaaaaacaacaaaaacttattataaaagcttgttattccgtaaaaccaaaggactccattcatttgactcactgtagttactaaaatgtaaacatagtggtttggtgccagagcaaaatacatttgtgctaatatatgaattcttgatatagttggtgccaaagtttttatagaagaattatatctcagataatgtgtgcaggcagatctgtatattatccataataagtggcctcatttagaaataaaggtttttataaggcttctgtaaattttacatcatggaaatttagtacaagtgaaactttttttttttccaaaggctttatactgttggtgtaatcttataaataggtcatagttaagcctttgaaaatgaagtatgtggtgttgacactatcctggtgttatataaactgactttcaagttaaccaattggattgtaatcatcatctatcccctttataaatgaactacactgttgtttttctgacttcgatgtgctttgaagtacagtgtagcatatcattctaccttgaatcctatgataatacagttgacatcttgctgtagtggacttgtgcatatagcacacatgatatagtatattgtattacagtaaactttagacaatgctacttaatcattttacttcatgaagataaactaacattttaaatatgaataatattaatggtctacaaaaaatttgagcacattttaaaatcatatttataaaaaactggccaaattggtcttatttaatgtataattcagaaccactgtgtagtatgtattcttttctctaaatgatgaaatgctaaagaatcatttcacgttgttgaagaaaataccgttgctacaacaacagcagcagctactactgctactactactactactactactactactactactactgacagaaagaattcatgaatgtaaactggaggatatcacagttttctttagtgaatataagtgaactacttgtgcgtgttaggtgtactatttgctatgtattttattttgctttattcagagagaaagttgattactgagtgctgaattatacaatttaggctaggaaactcgtaactttggtatttaataaaagaaactatacatattctgtttgtaatgtaaataatctataccccatgcacaaatatctgtttcctgggtgtgatatattaaagtatgtattcttattttgaggtatcttttggaaataattgaaagagattaaataacaatttatgccacatgaaaaataattacttagaagtagttaggtatcatgtcttatggctttttatgttccattttggctttttttctcatttgctttattactatatgtacttgcatgtaacagtttgtaagcatatattctgacttattttccttctgtcattatctagtgctgttatgccttcctatcagaatcgataagtcaaactcagaggtgtgattttggtgttgaagttttcaggacagagatactatttccatggatgcattttaagtaataaaattaggggaagtgaaatcagaaaatgaaaaatgattacaaaataactttcaggttttctataatcaatggctttaaaaagtagacagtcttaattaattttaaattagcttgctcagaaaggtcatgccatacagtcctatcataaaaggaacactataagaatta

SEQ ID NO: 17208 - DNA, 1149 bp, Homo sapiens
ttttatggttgtttacttcaaggaggggggtgttgagtagggtcttagtccattatggactaagtctaaacttagtttagtttgtaagtcaggaactgttcttatatgttatgtataatgctaagtgatataaattatggcatgtccaaaagtggatctgagaattgagcttagatatattgagattagaaatggttaacaaaactagtggcttttgagacaatagaaactggaacatctatctgacagacataatttcctgtgtatattttaggctattaagcttgagcaaaatgtcattttcaaaattttgtaatttggaaagtttctttttctcagatatttagttaattatatagatataatgttttatttctcagatatttagttaattatatagatataatgcttttttcctttatattcaaggttgttcatcgtgatcttaaacctagtaatattttatacatggatgaatcagccagtgcagattcaatcaggatatgtgattttgggtttgcaaaacaacttcgaggagaaaatggacttctcttaactccatgctacactgcaaactttgttgcacctgaggtattccttaaaaacttcaccatttgcctttcattcttttcctttagttgaatctatatgatgccatatgaatgttatggtaggcagataaaagctgttaccttgcccttttcagttttaaagttctttaaatcagggaattctcatagcccctaatataaatatttacactggtaactagcatctaaaaccaaccagaatgtaataatcaggctattctattctgttgggttatatactaatttcagaatcatatcattttagagttgggaggtagggaaaagatagccacagcttcaatatattatgtattctaaatgatgaaactggctcgaggtacttcaatgacttattcaagacccagcattcacttaataacaaagctaggatagattcatcaggtatgttaaattgtactgaacattaggtaatttatatagattagcattataaataacatataagggcagtgctatcctcgattgtctttaggatcttctaactcccggagaaaatagccacacaggggtttttgtaagccgtggggatttttcttgg

SEQ ID NO: 17209 - DNA, 1399 bp, Homo sapiens
catatatccttccttgtttcattttttcacatagcacttaaccaccatctgatatatatttaattagtttgtctgtctcacctaactcaaatgttaggtctgtgtcactagagatttttatctggtttgttcgctgctgtcttcccagtatcaaaaataaatttgttaagtgactaatttttcttttcattttaatactttatcaggtgcaacccagtttatgcctgaccccaagctcatggatcacgggcagtcccacccagaagatatagatatgtacagcactagaagctgaagtagactgcatgcagagactacacagaaaactacaagatgtgtggcgttgcaaataatgatgaaaataaatcatgtaatgggtaactgatacatagagtattacctaaaccaagtttctcccttacatttccaaatatgccatttgataaattacataagtggttaacacacaaactgtgaatgcagtgtaaacaatattaaatgattgatgaggagacttaggtagaagtattagcttgcatttgatgacctttaagggcacttaaaaaaaaatgaagacatgaattctagtgagattaaaatctaaaaatacatatatatatatgtatgtataaatacatacatatttatacatgtataaatacgtatttatacatatatgtataaatacatatacatatatgtataaatacatatacatatttatacatatatgtataaatacatacatatttatacatatatgtataaatacatacatatttatacatatatgtataaatacatacatatttatacatatatatgtataaatacatacatatttatacatataaacatatatttctgctctagctttcccagattaatgctagttaaattagaatggtgtatggaaaggtgtgtttccctctgtttttttttttttttttttttttttttttcccatttcctagagctggaataaaatatccatgttttatgggacttgagcttggctttgtcccttggttttgttaatgttaattcctcttaaatatctaaaaacatctctacctatttgagagggccatatgctacacaggcttcctaatactgcttagcaatccttctactggttcctaagtggtttactattgtgttccctggaagaggtattacaaacgttttattcttctcaagcctcttagaactgtcaaagttgactgtgcctcctatttcatagagaaaaaactaaattattagatatgaccattcccaaaacttcttcccatctaccttcaagacttacctcttttcagccatgcatcccccttttctaagacatgcttctctttgtgttcttgacctcattccttcccatctaagaccatattccacc

SEQ ID NO: 17210 - DNA, 1246 bp, Homo sapiens
aattttgcttaccactttggatctttgtttgaaagccacattttcagaaccagctcatgtattttctttggttatttgaattttattttctttatggacaagagcatcataacataatgataaaaacatatagaaaaactaaagtatcatgatctagatagaagcctgtatttggaatacaggtttgttttgctttctatgttgagaagcattgaaaatgctaatataaaggtgtttagacatttttacgaataagtcagtagtgttttttagtatcagtagtgatatttgtttgtaaattatttacatattgggaaaggtcaataatgaagaaatgaaagaatggaaggaaaggtgtggataggctcattggtatttgaatattctgtctgtcaagtaactagagtattaggctaattgtctacagacctaatttaatcctggctgtcctactgatgatatttggtaaattgtttaacttctgagcctacgtttctccatatataaagtggaaatagtattactatgcctactatatgagaatggttatgaagacaatgcaatgccatgtttagaatcggtttgccagaagaaaattgttttagaattttcccattgacttgatgaatctcaaaagtctcacgcaggaaataattgcttgctgtcagtcaacttccaaacaaaatagatcacagtgtttttattgcattaagctttttaaatgaaaatttcttttttaaagtagtattttatagtcttacagaccagtaaaaatagtaacaagtagaattgtggttttgaaatattactaaggaaaacactctataaattgttttattccttttctggtaggtaaacctgcaaccaccaaggactccaaattgtgtatgacagttggtaagccctaatatacactacataaaaacgttagggctgcctgtaatcccagcactttgggaagctgaggtgggtagatcacttgaggtcaggagttcgagaccagcctggccaacatggcgaaaccctgtctctactaaaaatacaaaattttagctgggtgttatggtgggcacctgtaatcccagctactttgaagatgaggtagcagactcacttgaaccagggaggcggaggttgcagtgagccaagattttgccactgcactccagcctgggtgacagagcaagactctgtctcacaaaaaaaaaaaaagggggctgtacataggcagcaaactaagctgcag

SEQ ID NO: 17211 - DNA, 1245 bp, Homo sapiens
tcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcg

SEQ ID NO: 17212 - DNA, 1111 bp, Homo sapiens
cttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaa

SEQ ID NO: 17213 - DNA, 1125 bp, Homo sapiens
gaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcactt

SEQ ID NO: 17214 - DNA, 1193 bp, Homo sapiens
attttattataataagtcatttatatgttctttttccacaatgtacacagcttctgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataata

SEQ ID NO: 17215 - DNA, 1182 bp, Homo sapiens
aggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagagg

SEQ ID NO: 17216 - DNA, 1174 bp, Homo sapiens
ggcgtgagccaccacgcccagcaagtaccattttcattcttaaatttgttcatatgttaaaaaaaaagaaaacataagcatgctttagttttccatcttcacattaggtaacacaatgaatgaatgaatatagttattttctaatactctcacacagattggttcttccatgggtaaatagttctctgtagccctgaattagattttttttttttttttttttccgagacggagttttgctcttgtcaccaaggggggagtgccatagcactcaccatgtctcaccatgttggccaggctagtctcgaactcctgacctcaggtgatccgcccacatcggcctcccaaagtgctgggattataggcatgagccactgcacccagccatgaattagattttgattgatgaaaagggagataataattccaataatcttatgttccataaatgaaattttaaaactgatacatttttatatttaaaaacttcaaaataaatagaaaaatacaactttgagttgtagttttttttagtggtcaatctgatgagcttgggcccgtataaggtatgttggacaagaaaacactatcctaatcaatgttgacttaactgaattcattcagataagtggaaatattgttagatttgttgactggaaggaagtctgagtttgattagtccaaaggtgatttgaggaaaggtggtaagctgaacatgacctcccctgagtattactgaaaggaaggagaatttgaaccaaattttaagatttggccaggaccaaataagatatcattgcagaaaatctgtgctatatgtcaatgacccttcagaaaataaaaagtaaagataaaatggagttggcactccatctctggcctgtgtgtgctgcccccacccccacgcctcccttctgtctctcaagttttgagatcacccctgttaacctcctcttctcttccctggctcagccaatttgtaagctctgatcacatttttttttttttttaccacattctctttgtaccctatcttttgctttcttatagttgcttaatattgtgtaacggaggccaggcacagtggctcatgtctgtaatcccagcactttaggaggccgagtttggcggattacttgaggttaggagttacagaccagcctggccaacatga

SEQ ID NO: 17217 - DNA, 1510 bp, Homo sapiens
tttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgtagaaaatactgtttctactcattcaaagcacattgtagatattcagagagaagaacaaatggctggcttggcaaatccccatctgagataaagtaaacaagtgaccagcagcccacagatgattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttaagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagct

SEQ ID NO: 17218 - DNA, 1168 bp, Homo sapiens
tgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccatcatctcctttggctgctgtaacaaattaccaccaataatatgatggcttaacacaacagaaacttatttgcttacatttttgaagggcagcaaagccatgctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaattcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttatatttcaaggcctggcagtaatcctctt

SEQ ID NO: 17219 - DNA, 1745 bp, Homo sapiens
tcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacagccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaatgttgtgctgcctatgataattaagattaaagacaagtgaaaaggcatgaactatcgggggggagaagcttcaaccaaacagaagtgcaggagtgcttttgtatgtgcctggtccagtggagatcatgggatcatattaaaaacatacttgtaggaatcataaggttttctttagcactgcttgccagagtagtggagatatggtacaactgaaaagtttagaaacatcagaagggtgatttacacgctccagagaaactgtttcaacagagaagtttttcgttttgttttgttttttgttctgttttggtattgagtatagaattaagcaagtgggcttcaaatgcttagaagggtaaaaatctggaatgagtaataaaaggactgtagattattattttctggagagccttcaatagaatagctcatcatgggt

SEQ ID NO: 17220 - DNA, 2116 bp, Homo sapiens
ttgtttcattttttgaaattcaggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtgggtaaggcagtagggatggggttaggtaggggagaacatttctgaaaaagaacttataatgaagctacaaatccatccttatttcttattcagtgctgaatactacctcatgcaaaatattggtgtggctgcaaatttccctctgaagctgacacaattaaggatgaattaccataacatcttcatttttcctcatttcattgcctctcatacagttttctccctctgatttatttcattttggtagtggattttgaattaagtatttatttctctttgcaagtgactatttgattaacacattaaaaattttttaaaaatttcccctttaagttatgatggctgcctatagaatttagactgtttctcaccctgatccatcctgatattatgttattagctacgatttcaaggtcactttgaagtcagacttcacagttttctacaggtgtatttcttgctatgctcagtgggaaccagggagcagaaaagattgtggaaagtgggaacattaattgtcacgtggctgttgagccagagaggccactggctgccatgcctcttaccagccaagttttaaatggttagagtggcattggcattgattttgcttttctcttgggttttcttcatttcttttcataattcatcttcaagctatagatccatccttcttccctatccaaatactttgttctcagtgggcagtcagatttttttggcttccaaacctcactgagcatgttcagagaattcctctcattaaggaaatatttttccccacaattgtctgatgtatgagtcctctcagaagcacaagtgcatactaggaaggctttgtaaactggttttgtaggcaggctgtacctgcaaataggcattctgagcaaggatcctaaatttccctttggctcatgtcccccccgccccaccccaccttctcctttttggcatgtctggtgaaaagctacaaggttcacagggccaaatattctcccttttgttctctaaacatgttgcacacataaactcaagggagtgatttcggttcctaagtcctagggagttctattccatttattctgatgtcccttttaaggaggagttggtgttgaagtgtgacatgctttaatgataactgctttggcaattccccagacaggtatacttcttcatccaaaattgcacctaaggtgttcatttagacaaaattgttcgcttagtgatccactgatctctaatcagaaatatttttaaaaaatacaatttagatctctgaaaattggaaccactcaagagtatcatcttgatagtgttacttcagcatatgactgactgattttatgaagggagtttagctgacttttccctgtagccctatcatattaaaaacaaaaagtggtccacttgaagcagcaaggacaaagggcagtttagggagaggcagggtgaaggggatagctcgattgggcatccagagtggaaaaggattattattgtacataatagcagttctggctggaattccaatccactttctggggatcattttgatgttgaatgttcccccaaagcattctgacaagtttggtccacttggctctttaccccgggtaataagacccttattgactttgaaaaactggcataaatgagcttaagaaatccattgtatacagtcctagtgtttgccttcttggtaaaattacatttaaggatgtcatttcatgagtcaaattgtatctgctgacactgaagtgtattgagatgttgttctttagtttaagtatgtaacaaagtaatattcaaaggggatgtttgggggtggggctgggaccgggtggctttatattgataatgaaatattccagagcaaaacacattgtcctaatgaagttgttgcagc

SEQ ID NO: 17221 - DNA, 1622 bp, Homo sapiens
ttttgggaagacatgtgtttcaatggcgttagtatttgactggtaaaatactgtgagaactgttgttggctgaattgatccctagggcacactttgcattttacttgagccactgactaggaacacataggaaggtcttcattagcaggaatagattagaatgtatgtaagcaaatacagatgttgaaatttgggtaacaagtacattaactttttttctttaattttaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctagagatcagacttttttgattgtatagtttgcattaaaaagttgtacagggagggatgtaacctgtatcttcaggat

SEQ ID NO: 17222 - DNA, 1175 bp, Homo sapiens
gaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgcaaattgatacacatgacctttttgcttttaaaaagcttaacactaagggtgaaaccttagatgtgttttctacccttactgcagtattgtactttaacatattgccatagttttgtttttaagttaaccacttattcttcttgatgatatttgagaatttctcagaagcaatgttttctggaacttggtttttgtttagtttgcttccagtaagaattattataaggctttgccctctgaaaatattctagcacttcggagtcttctaggagaaaatatcacatgcttagagctataaaatggtcagaaggctaacagagcaaagagcctagcacagctgtgtgtttagtttagaaaaatccaaatatcaaaatgcatttgtttcaatagcaggtctgaacatgtataattcagagttaagacaaaaattgttttagcactggtttgagtgtgtcagcaacacaagagactgttgacatttacttgtgtgttcttaaacttatcagtctaggcagtcaactttgaaagtttaaaaagccactgatttttcacatgctcaagatgaaataaaaacagaaatcaaatgaacaaaatacatttcatcctatcttccaggcagtccctaacctgcagccctaccctgtaactacgtttattctgggaacttacaacacagaaaaccctaaaacttgtacattcttctcattttaagtggaccaaatgtagagcacagtcagattgctcattaggtctgctcctgcctgcttccttgcggataggtatgaacataattagtgccattagctctaatctatgggtcttattgcctagtatttctctctctcgccgcgccgccgcctcctcctctccccccaccccaaccccatctctctcgtagtggcattaaggaggaacatggtttctctctatcaggccaacctcaagaggttaagagttgccttaataatcagtaaagttctactggaactacttttgagccaatttatattct

SEQ ID NO: 17223 - DNA, 1815 bp, Homo sapiens
ataggatttattatattcattaccatgaatataatcacgaatttatgcctactcccataaatattcaagccttgggatattgattttggcagccatcatatcttgaagtgagtgtgtcaatatatttagacatggagaccaagagtgatgcctttctcattaggaactcgttgtaagtttcaagattccaaatcaaggtcattgaagatgaagttgtcatttggtcagtagttgtctaataagaatcatgtcttcaaggtttcattgtgcattttcccaaagccttattaaacctgaattagctgaaatccgggtgaacaaattggcaacagcagtggtatccctccctatgtaaacaaccatcagtattgttttactgttgtaataaatgaaacatgattagccaccatgagttcatgacctacctttattgtgctcagactagtgacaaaaaaaaaccaaaaacagttttatccctcaagccgtagaggttcctaaactattagaaacaaccatttgttcattcgtggtcacttaatggtagaaaaaatagataatataatgctaattcagtacaaccattcttctaatctataatgagttgaattgtctgggcacaatgaagtgtgaggtttctctcttaagagccctgggcttctctccttctagggattcactgtgacgactaacatcccagagccagtgtggtccttgtaggccgaggttgggtagatggcagaaataaaaagcattctgatagagaatgaaggcattttgcttatgttattagctgaatgattccttagcgatataggtaggagtccacaaaaatctatgaaaattataaattgttattttttaaactagacattaataaactcccttaatagtgataaagagctcctcttgactaaataagtcatcctaacatggagttcaagttttcacaatcgcttttaacagaataatacaagatgacagtatagctgacttgcaattataatacaatttcaattacaatgagcatactttctagattttctttcccaaatggagagcccaaaaagaagtaacaaaagactcattcatcaagtgaagaagaaaatcctttattttttgatgagcaaaaataagaataaattgctgttcacactggataagaccatatcaaaagtgacagtaaacatgtacactgttggtgttatatggggatggggttctcggtaattttgtttattatttatgtttattattatgttttatcattaattattcaataaatttttatttaaaaagtcaccctacttagaaatcttctgtgggggtgggagggacaaaagattacaaaccaaaactcaggagatggtaacactggaattgataaaatcacctgggattagttgtataactctgaaccaccaaacctctgctatcaagccttgctacagtcatggctgtccagaaagatttacagttatttttctgagaaaggatccatgggctttaagaacttcagaactttaagaacttcagaagttcttaagttgctgaagctcaagtaacgaagttgaatgcaatcaaaaaaagaataccagggagtcaaggcttgagaggcacattcttatcctaaagtgactgctcaaacctgacgagaccaagtaaattactgaagatacaaagagacaaaatgcagattaccgtccttattcctataactcaaaaattttctttgttgaagtagaattgaacctttctaggatccagactggaatatcggtgacagcatttgcgcaggctctttgccaaagtccgagg

SEQ ID NO: 17224 - DNA, 1186 bp, Homo sapiens
acagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtggcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacactgaataaatgtcttttttttttaatgtgctgtgtaaagttagtctacactgaagccatcttggtaaatttccccaacagtgtgaagttagcattccttcagggtgatgccaggttctatttggaatttatatacaacctgcttgggtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagag

SEQ ID NO: 17225 - DNA, 1169 bp, Homo sapiens
ccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcag

SEQ ID NO: 17226 - DNA, 1169 bp, Homo sapiens; identical to SEQ ID NO: 17225

SEQ ID NO: 17227 - DNA, 1188 bp, Homo sapiens
cttttgttatttttacaccctgaatattttttgtgtcaaatgaaaatggctatactgtattttctgattacaatattagaaaagaatgtcatattaaaagaaaaaaaaggaacacgaaaaagaaaattaaagctctacttgcaccttctgctttccttcctgatacccccttccacagcccatttggtgcaggcattgtacttagagagggcaggtcgtgtagggggcgggtggggagtgctggtcttatagtctaagagagaaataagtgattactcaaagaagaaacataaaaggccacagccaagggccgggagtgggtagggggatgcagaccctcccctgtaactgaagatgggtaaactccaaccacaaggcgatgatgccacttgtgggccctcagattggagaggacggagatgagtgacaacgcgtgcgcactggggcaccgagcacagaccagagaacggggatgtctgtgcgtgcggagtggaggaggggggagttcctggtgactggccgccggcccttggtgggtggtagggggtgctggggaggagggcgagctcggcggtgacgcgcggtcctcacgtgacccggagctgcagagctacgcagccttcgttgcagtcgtcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcc

SEQ ID NO: 17228 - DNA, 1480 bp, Homo sapiens
tgtttcttgcactccccggactgtggcgaaatggcgtgctttgtgtgtctgtggttggggggaagtgggggaaatgacagcagggaaacctatcggatagtttgttcgtaatcctcctctctcaacagcacttactctccatgttttcgatctgtcatcctgcaggtctgctgtagcaggtggctccgcttgaagcgagggaggaagtttcctccgatcagtagaggtcggtgtgggcgtgggggctgcctggaatgggggaggggttagaaatcgccggcactttggacaggctcttccaatcctgctttattttccttacctccctcccatttcaggctagggagggggcagacctgtgcatgtctgggatagcataaagaggttaaaaacaaacctgataaccggaatggtgaatcaggaaagcaacgaatcaacagtcaacccatcaagtgctccattctcactggctctggtctctctgcagattggaaagattgttgggagtggcacaccactagggaaaagaagaaggggcgaactgcttgtcttgaggaggttagtgcaagggttctagtcaggtccctagggacatctgaggttgtggtgactgagaccccagcagagtctgtggattccattgacattatctaggctttgggcggggtgacctgggatggggagggaaaggctgaaatgagaggcatagagatttcgtcaacaatctacatttcctacctagcattcaattattattatcttgtccctctgtgcagctccctgcatggggcaacacaagcagaagagaaactcaaacccaattttcttcttccactcctaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtc

SEQ ID NO: 17229 - DNA, 1208 bp, Homo sapiens
gctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgacaaaaagtcgttctaatgcttgaatttaaaacccagatggagagataaggtacataaatacaaaagtatatatacaaagatctatgaaaaataataataataaataaatacaaaaggattactaacagtacctgggcatatgctctttgtcaaatatacactatctgtttaaatgaagcagaggttgctgagaaagcttcaaggaggaagggcgcatttaagctgaaccctgaaggacaacatagaagggcattccaggagggggaaatgctttggagaaaggcatgcaagtgagaaatctgtgcctgtgataggaaggtagccaatttgcttggaatggaagccatgggaagaggaatgatgagagataaatgtgaaaattcagagtgaggaaagtttgaggaagatcctgaaccccaagccaaaatattgaaataatatcttgtcatatta

SEQ ID NO: 17230 - DNA, 1108 bp, Homo sapiens
tgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatg

SEQ ID NO: 17231 - DNA, 1267 bp, Homo sapiens
gatggatctacagggaaaatggtgggctttgcggaagggaggggctcggattgagggcaccccacagggcatactggcttctcaggtggaaaaaaatgaaatgttagagtataaagtcaagtccagggctctgaattttaaaaggtgcctagtagggcctctgtcctcagtgcttatcagtccaccaagaattcagcccattttctctctcttgtctcctaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggggtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagata

SEQ ID NO: 17232 - DNA, 1217 bp, Homo sapiens
aggatccagctttctctagttggaaaacttttgacaattagggtactgagtcaaaaaaggccagtcgctatgggaccccatactctgactgctggtctgtttgcctggaatctagtagttttgtttccttgttttctaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagatacacacgtttaagactcagtcttttcatggggaaaatatttgcttcacagggctgc

SEQ ID NO: 17233 - DNA, 1650 bp, Homo sapiens
ggtggcggcgggtcctctctagcgttccgctgcagcagcccccactcttcccaccccggccgtctgcaggtttgcggggccaagtgttgcggcgacgcacctcacgtcgagaatcgggaggaggagactgcaaggataggcccaggtcagtgcgagggacggtggtggggagggggtcagaacatgaggaaagcccagtctgagaccccaatccgtgccttcacccccacacttagcaatcccccacccccaccccttcttcgtcctccattttggtgcctgcagaggcctggagatggatctgcagagaagatggtgggctttgcgggagagaagggcacagactggctcccctcgcccccccgagggtacatggggcctctctggtggaaaaaaaatgaaatttaaaaaaggcctttgaaatccagggctctgaattttgaaaggtgggtagtcgggcctctgtcctcggtgctgatcagttcaccaagaattgagtccattttctctctgtctcctaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagcattctctgcattcttttttactttaaatcttaaacatgcacctaaacagtcatatatatatatatatatatatatatatatatatatatatatacacacacacacatatatatagtaaatagtgtttatctctgtggtagaattaagagggagtttattcttgcttacccataatttcttatttttcaaaatggaacacgtattactgataaaaagcaatgtgaccaccttataaaagcgatgtgagcacttactaaacacttgtgacagaatctcaattttagcttgcctctgggttctctttttagaaatgtaagagacacatctctttgaagataataatatttatcagtaagatgaagacaatcacctcccaggcttgttgtatggaccagataaggtaatgaggttgtgagctttctcccaagttcttgttcttactgacatgcatgacccaacactttagatattcccttctgttattagaggaaatt

SEQ ID NO: 17234 - DNA, 1206 bp, Homo sapiens
ttataacagctctgaataaaaaaaattaaatgctaaggcctctgtccacagcacctgtccactcaccaagtctttaacttactgtcttctttttgctttctagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaagcaacaagcagcacgtattagtttatttctaaaagtattggggcatttaatatttgttgacagaattttagaagaaatgtgaacttgaaagtaactccagaccacttagctagaataataaattttacatattttctcatctttaaaataaagaaaataatctcacaaggatctggtgagggccaaatagagtaatgactgtgagctatgtttgacagagttttgttcccatcccaactccgtaagagattaatt

SEQ ID NO: 17235 - DNA, 1245 bp, Homo sapiens
aaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatctatacatttattgtctcattaaaaatgtatacttacatataacagatgaactaaaaaaaaatctgagattaaatacactagagtgttaattggtgaacatttctgtgtgttaactaatcccagcactttgggaggctaaggtaggcagatcacgaggtcaggagatcgagaccatcctggctaacacggtgaaaccctgtctctactgaaaaaaaaatacaaaaaattagccggtcgtgatggcacacgcctgtaatcccagctactcgggaggctgaggcaggagaatggcttgaacccggaaggcggaggttgcagtgagccgagatcacgccactgcactccagcctggacgacagagccagacagtctcaaaaaaaaaaaagtaatatgtgacatttttttccttttattatctg

SEQ ID NO: 17236 - DNA, 1157 bp, Homo sapiens
tgttttcttgagacaggagctctttagcctccttatgttgctcaggctggagtgcagtggctattaacaggcacaatcacagcacgctacagcctagaactcctgggctcaagtgtttctctcacttcagcctcccaagtagctgggatttgcagtgtatctcgaatgtgaaatatcttcccattgtccaggcataatttcccaacttttattcatgctattacacatctatgtctgtaaatctggaactaatctgggcagtcttggtgaaaaaaagtcagtgattgccaggagttggtttttatgtgtccaatctactatccaaatccctcggttagtttaggtatgcatcccatttagaacttgatatgatttgttattacatgtgattggcatgtgtatattttctttcggtttaatatttttaattgtataagtgaggtacttcatacgtgtgttgattactcctggggccctgggccgagtgagactgtgactctacttttaccctgaatcccgctgtgttaggattctgtcctctggaagctgtggtgctgagccctagtggtttcatgcagtccctcccctttccctcccctgtggcagtcactgcttggccaactaggtgggtaaacagaggagcctgctgtcaattcaaaggactttatttgtgctagtgcagaaagaagcatgttgtgaaaccactttcatctcatgaccttcactaaaatcttgaaaagtagaaatgtcatctggctgttgaatgtgaggttcatctgagagacgtgcttgcccttcccccgggtgtctgtaatttccctaaacctgcccacctggggatgtcatgtatatagattcatactttaattctaggaccaccctagtacctaattgtcttggcttacacatgttatcattcctaacggtgagcaactttccttgaaaagggcaggggtattttgtttttattgtttttttcacttccaaaaccaagacacttttcttctagataaaaatggaaaatgcctgaagggaataaaatctttaaaaaaccttaaaattttattatgcatggataagcactgtcaagatttgaattttttttcagaagttatattatgcaaatgtaattatatatttaagaatagaaataaaat

SEQ ID NO: 17237 - DNA, 1622 bp, Homo sapiens
ccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaagtaatttgtagtgtgcctttcatgttactggttggtattctggttattgtagaaataaggttggtattctgtggttattgtagaaattttagaaaacatagtaagaacaaatgcaaataagaatcatgtaattctactggatccttcaaggtcccagcaaataaatgggactcaaaaatgggtgatttgaggagagttaaagaattttttccctgagttgccaccagaggggtagggttgtagtgtatattagctggctcaggctgccgtaagtacctcagactgagtggcttaaacaataagtttattttctcacagttctggatgttagaagtcagatcaaggtgttgccagaggatttttttgaggcctccttggct

SEQ ID NO: 17238 - DNA, 1262 bp, Homo sapiens
ggtacgatctcaatctcagctcactgcaacctctgcctctcgggttcaagcgattctcctgcctcagtctcctgagtagctgagactacaggcgtgcaccaccatgccctgctacttttttttttttttttttttgtatttttagtagagacagggtttcactacgttggccaggctggtctcaaactcctgatctcgtgatctgcctgccttggcctcccgaagtgctgggatcacaggtgtgacccactgcgcccggccttatctgtctctttaagatcctattgcatttgggatcctgtagtattatgccactgcctatttacctaataatatatattgaacatctttccatgtcagtacacagatctctgcttaattcatttgaatgttcttctgtagtattcatacataatttatgttatcattttcctgttgaagaataggtaggtgttttccagttcttcagtattgcaaacaccactacattgaacatctttgtatccatgtgcaaatattcccgcaacatactgtgctagctgttcagccacatcacctttatgaaattctcacaggaacctgtgaaggctataggtaatttgccacattccacagatgagaaaaaggctaagagagcttacatgtcttgcctgaggtctcacaactcataaatgacggagcctaattgaagtaaagatctgtctgacagcagaactcaagtattttctctgataccacgatttacaattgtggtatatgattcatatatgtgtttaaatgtaaacatataaaccacatgtttataaattactcattttttttctttttcttagatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgtgtaagtcaaaggaattgtttcctctgtcacaccataagaataatggaagactattttttgcatccttatcttactagcactccctgctgcactttacactgtagattatacctttttcttcttggaacgctcatcatctttggcatccaaaataacattcttctaattctgttatggctactcttaacatttttgtttcatttgtggtctctgtgcatcccttaaatgcctttcgtccttaggttttccagaattccatacttgaagttcttcctc

SEQ ID NO: 17239 - DNA, 1136 bp, Homo sapiens
gccctaccctggctagaggatgtaagcaaaggatgttggcaaaaaagctctgagggggaaagttggatccaactgctatttctgtttctatagatctaattattttcccttttctccaatcataataaatctaaagggagttatttggacacatttcccaggctggaaaaagccatttcacacaggagagaaaatatggccaacagagtaagctggtcttggctttttgtgactttaacatactgcacctgttgtagctggaggagcaaagatgaatggcttgaaatccaggggtggggcatcctgcatttgggtattctctatttaggccaaattctgaggggtgtttgtgtgtggggtgtgtgtgtgtgtgtgtgtgtgctggaaaggaacattggagccttaaataccactttgtggcttacatgcctattaaaatagaactttttttcccctggctatctataggggagaaggactgagaagctagagagggaagatatctcaaaaccacgctaaggagggaatgcacagtgtaggaggtaaagtgtggagatgggaaagagtgatttgtattgaagtgagaggggctagaaaaaaagggattagagaatggggaatgaagagggtgctggaggatgaagagaggtgggcagggttctgggaccaagcccttgagaggactgggcagtattttgaaatttcttccagttatcaagttattctattgatcatggcaaagcttttgctctgtccagtttgaaagacagtcctctccaatcagcctgtaaaagttggtgagctgggttacatgactgctgtgtccagagcctggtgctaaggcctgctgaggagatgaaaaagagcttccctttcctggggaagcttatggactagccgggaagacagtgtaggattgcatgggtaaaaagtaaaccactttaggcagtgacatgaaagggggccaccatgctatggagttgttggttgaggagagagttgagaagaaaagatgtgaatggctggctggttcctagaacactcctaactgactcttggctaagggttccctggagatcacatggattttctccctgccctctcagactgaagaattctttttccctagctggagc

SEQ ID NO: 17240 - DNA, 1104 bp, Homo sapiens
aggataagttttaacaatcaaagtcctacctcagcttcccaatgcttgcacataaattggaatgtgtacatcattcattctgtctctctctgtgtgtgtgtgtgtgtgtgtgtgtgtgtgcgcgtctgaagaggagtggggagtataggaaacaagatagtccagatgctgttgccgtggtaatactaaatcgtgtccaaagaggaggctgagattcctttttagttaaccttgtccacatgatttgactatccagcaggcttggattcccaggccccagagacttcgggactgttttccagcacttgaatgtggtatataagtgctgatatcaaaagggatatgtaggaaagacaagattataggcagggcattgtctgaccaggacgaggcccgaagcaaaagtctttgtttgtctctggcacctcttgataattgttgttttactcctagaacccacccactgatccccatccatccctagtaccagtcacggctgctctagcatttcggccttgtcaactactgcaggccctgatcaaggaggcctctgttcatggggtaaggttaaggggtgggttctgggaggagggtaagactgtagtgcagattcgagacctagggaggtggggccagtttctcactcaatgagcctgcctgttgtttagctctattgtatagggttcttctatctctccctttgtcagctggattcaagggacaggctgggaattgtgcagggtacaattggtctctttctaccattcctttcgatgaaagcccttcctctccttcctttgatgagttcccagattcacactgaatttccatcatggagctggtccttgaggcgggcccagggcatgggaaaggagggagggagggttgggagctcttggtgcctgcttaaagagacagcatcaggatcaacacagtcccttgatgaacctggatctgtgtaagtcacattggttctgttgatctctgtcagaccgctgtgaagagcgctggtgagaagggcttaaagttggagtatcaactatcacagattgattagacttgttttgggagtttgtatacaaatgtagccaaccatgacatgat

SEQ ID NO: 17241 - DNA, 1164 bp, Homo sapiens
tgaaaattcttctaactggccattaagagtaaggaagttgaatggtactgctgaagatctgagttgactcactgaaattttattttcttatttttttaacattaaaattatttctttttggctctccctctagttattttttaaattaaggtaattactgttttaacctagagcatataatggcaaattaaattttaatttgacactcataccgaactcagaaaagcttgtttgatcttctctaaattctgtatgtagtactttttttaattgtcacatttctttgttacatctttgtgtccaacaaaacctgtggaaatctgtgttcatttttgtggtgagggatgggggtgaaaaaggggagacttgctctaattatgcatatacatttgactatgtaaaggtagttgtagactatatgtataaataacaagttaacacttaatattctaaattgttctaaggaacagtggcctgaagccatgactagttttgtggagctgctggctcttttaacagtagctgacctattggatttaaactgagactgaaattgacatttgtggttaggttatctagctgaggcttttaacaatggagcagataatgtctgttcctgtagtggatccatttaatttcctatttgagtactctcacttaacaagtattatctattctgaacctttgtgttgggaatttaaggactattgtcaaaggctattaatggtaaacaagtatatgcaaaacaattcacatatgggtaaaaatttcaaattgtgggtttttgtttttgctttttagtttcaaagattagttatgtagcagcaatatcataaccaaagcaagtaggaagttgactggtttggagaatcttcaagtagttttaaatactgtaatgtatcagattgttaaccaggatttttttttcctgtattactgctaaatatattactatattaatgcacttttgtatatataactgtcttctgtacattctgtacttactacagtgtatataaagcctgttttccctgaagctgtgagggaataacaatagttgtatcataagtcgtttctattttgagttccttcttgtacttgaaagtagttcagtagtgaaatctaaatgagtgtgtatggttgtaattaaaactggcaatgtgg

SEQ ID NO: 17242 - DNA, 1208 bp, Homo sapiens
acttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagatcaatcagcagatattgggtccggtataccaggtattattttggggtaagctaacaagtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttctttaggtggtaggactatggttgatatttttcttcttcctatcttcctgcctttttcagattttcaatattaaacttgttattcttacattggaaaaaaataaattgtttttaaaaagatcaagtaggcttggatttgaatatcaaatgagagattatgtgaaaatataaggtaatgttatatttctaatttatattaaatttagcattacctctggaagaagaaaagcataaacaaaggcatggaaaaatttggaatgtgaaaaatgtgttcgatagaagtggtgggttaatataaaggggactaaggttatatcatgatctgttcgcctgctttggtattcgcattttaataagggattcttgaaaaacctataaggctcaaattaaaaaatatatttgtcatcaaattaatgggatttcaggtagttagggaagtactttagagtggaatctgatgtccctcagaatatacctactta

SEQ ID NO: 17243 - DNA, 1207 bp, Homo sapiens
ggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcatttttttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgtcaggggttaaggttggaatgctccttgactacaaagtggtagcatgaggaatttgtcttaataattgaaattttccgtgt

SEQ ID NO: 17244 - DNA, 1154 bp, Homo sapiens
taagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaatta

SEQ ID NO: 17245 - DNA, 1130 bp, Homo sapiens
ggatgaattacaacggattattcctaaggatttttaaaaatctttataatttttctggggtcctcaatatttgtctctagagataacattctttcttagactgcttcgtatacacagaaataaaaaactaattaaatgttgaaatatttctttactagagcccatttgccatatttcatccacctagtaaataaaagagtaggacccccaggcctaagcatcaacaaatgctattaagtcagaactatcagcagtaatagtaggtagtttcataagtcagttgacttatttaatgaatgcttcctccacaagttatcagtcttcaaaaagctatatatttttctagtgaaatattttagatcaaaatgttggtgttctcacagccatttaagctagcaaccattgagtatcattgaattcatagcaataaacattgattaagtgtctaatatatgttaaatattaggcatatgaattttagaagaggaacatacaagcaaagaatgccaaacggaaatggaaataaagcgttctctagaaaagaggatgccagtcacaaatcccccagttgtttgtttatggttgctggaaaataaaaaaacaatatacagagaggaagtagtacaaactggagtcagacctgtacagccacacttaacattctatgaccttggcaagtcacttaatctgagcctcacatttttcatctataaagtgaggataataatgctacttacctcactgggttgtgaagatgaactgagatattatccaggctgaagaacagaaaggaaaacaatgaataaaattgaacaagagtatagaacctgtgtgacaccattaagcattcctacatatttctaatgggagtacaggaaaaaaggaaaagaaatgaaggagcagaaaaatattctaagaaataatggctataaatacccccgatttgatgagagacattaacctatacatcccagaagaaaaagaaattacagacagatacatcataagaaaaatgctaaaacccaaaaacgaaaagaaaatcttaacagcaatacgagaaaaatgagccatcacttaccaaggaacccaaataaaattagtagttgacttcccctcagaaacaatggcag

SEQ ID NO: 17246 - DNA, 1984 bp, Homo sapiens
atgcttggttaatttttgtatttttagtagagacggggtttcatcatgttggccagcctggtctccaactcctggcctcaagtgatctgcccaccttggcctcccaaagtgcagggattaacaggtgtgagccaccgtgcccagccgtaagtggctatcttaaaaatgttatgaagaatagctgagtgcagcctcatgacagggaaacagcacagtgttgcagttttaagaggaagggcacttgcctggctgctcatcagtgtctgcaaattggccagtcatctctgaccatatgatagtaacctgatttcctttcttgcctttctaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtgatttggggtctgtatcatacataatctgtactgatctctctgctaaaggtttggtttagatagatgtcttgctgtccattgatagctcttatttgtttccaaactacgttagcttcattgttaaaccaagagaagacattggcagcagttttattcaactgtaagactaagatgtctggagtttactgagaatgtgataagagtgtaattctgtgcagtatacctaaattatagcatgtataatgtctggtggatctctggttcttactcctgaagatccaaattaggtattttcttatgggaggagaatttctgtgatttattcattttgaactaattttgccaaatgtgataatttccttccattcatcagtaattgacatacgtttggcatttactttctttgttttttttgattttttggtttttttttgagatggagtttcgctcttgttgcccaggctggagtgcaatggtgcaatcttggctcactgcaacctccgcctcccgggttcaagcaattctcctgctcagcctcctgagtagctagaatttataggcatgtgccac

SEQ ID NO: 17247 - DNA, 1160 bp, Homo sapiens
aaaaaaacctagagtctcgggtttatctgaggcacttatatctcctttaccaatatttataccaattatttcatgttctaactttcttttgcctcagctaaaacatttaaaacactatggtgatatcagacatccttgccttgttcataatgttactggaaagggccttagcatttcaccatttagtatgaagtttgctatttattatatttgaatgctgttttatttagaattttcacttggactggctactgattttgtttaaaaaccttttagaatatattaatataaccctatatgttgattttttctaatcttgaatcattcttttatatttggaataaaaagtgtttggttatggtattttattcttttgttgccctgctgcttttgttaaacatttttctctatatattcagaactgaaatcaatctatagccttactatttctgatatcatttttaggtttctgatattgtggaattatactagatctagtaaatgcatttgagacctttttgtctttctctgtggtcttaaatagtttaagttgtgtgagaatgatttgttctttcaaagtttatggaactcagctctaaaaccatctaggcctggagccttaaaaaaattacagattgttaatcacccttccaatctggtctaaagttattagattcttgaggttttgttactccttcttgggtaaaagcatttaatagattttaaaatcatgtggtatacattgcatatgatagtcccttataattaatatctctccaatggtgtgctggtgctgactttccaattgtgtgcatttttcccatattttggtttggtgtctatacattggtagcttaaaatccactaaagtgtaagttttcacgccatggaaatcagcaagcactacaaattgcggcttttttttttttttttttgagagccaattgttaaatggttatcagcatactattgtctatatctataagtgtatctccttttccattgttagtattgtatttttgttttattttctccctttttccttaataagtaatttcaaagaagcagcttttgatgttaattatctgttaattatcccttgtaagttagtttcattttgattttattagtttgagctttttaaaagtgaatttcctcct

SEQ ID NO: 17248 - DNA, 1180 bp, Homo sapiens
cttttaaactgctttttcaaactttaagctgcacgaattactattaacagtttatgaactgaggcttttctaaattctaaccctgaattattacatgtagtgtttgaggtaaacaactacttatctctgtaaaatgagaaagttgttccttaggctagcatttagatcccttcttctattgtaagtagaaccagaattatgatttacgatctggtattacaaggctttttttgtagaattttaacttacagtctccctatgcaaactgatgtttctttcctgattaaataactttccaatgttaccatttcttaatcatatgcacttcagactacctagcaagaaatcctaaccattacatagaattggtagtgattaattggtctctggtggtccctgatttcagacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgttgactcttgttcctgctgagttacttgttcgaagcttacagcttgttttccaggcatcgaataactgttgagattgttctactgttgtcgtatattcttctatattgaattctggttaatttggagtaactaattctgtggctgttgtgagtcttcagcaccctcccatgtaccttatatccctctctgaaacagaacagctccaatagcaacaagctagttgttctgccagatgtttctatgtggattctgtaatgttcctccatacagttaaaacatcctaacttgtttttcaagctcactcaggcctacgccaaacgtttctgttttttttaaccatgaggtttaatttatttttgtgataggagggatatttacatattttagtggaccacattttaagttggatggtgtgctctaaaatactgaaaaacaatagcccatatacctatgtatttgtttttgatgggttgtttactctgaaataaa

SEQ ID NO: 17249 - DNA, 1323 bp, Homo sapiens
actgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaatttt

SEQ ID NO: 17250 - DNA, 2701 bp, Homo sapiens
atattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaagccaatttgtacttcattatgcattgagataaaatctccaagtttgaagattattaaccaaacttttaaacacatatttttaaagtactcatctccaggtttatggaattgcattaagcagttaaaccggcttgtatagtcccatccattagttcagagtatttgaatcccaaactgttactttggtccagtcaatagagtaaaacccctttgtaacactgatactttgggacaaaacatggattatcagtgggcgctaccaaattataactgctacttttaggctaattaatattttagagagaaattaatttgagttatatgagggtgtgtataaaatggcattaagagctctatttcctggctttgccactgtagttgtgtaaccttcagcaaattaat

SEQ ID NO: 17251 - DNA, 1268 bp, Homo sapiens
gtatttagcagaatttctggcttattgtgtgcactaaataaatgttagcagtttttaatagtaatagtattacttaacatttcaagatcatagtggtgtattgggtaagagtacaggctctagggtggtaaaagcctagattcaaattctaccactagctctgtaaccgtgggcaaattacttaacctctctgagcctgtgttcccacattcataaaatgatatgatcaaacttgaacattaccagagttgttgtgaggattaagtgagaaaaatgagaaaatattaataaagcatttaagatagtatctggcacataagacacattcaatacatttaaatgatgatgatgatgatgacgatgatgtcggcaactaagatggtgagggtgatgatgacagtcatcatcattctcactatggctgctgcttcgagcctgggtgcctgttgttgcaataagatggtagggatttgatacaggaaagcttttccaagaaaatcttccctggcatcataatttcatgcagtgggcaaaggtattggttccatgaagttagcacccatgtaataatttctgcgggacagggttgtttggctgtttgaggcttaaggacgtgtttgtgggtaatgtgaaggtactttaaattatccagtcctttctgggtgactgggtgattctgtttaaaatggcaactcttcttacatctctaagatttaaagaatttagaaggtggctctcattgttaggaagcttagctttccggggacctattggcttaattattattgctctttatcaatgggctggctccatggtgcaaactctcttgagattggtagtctaggaaaccagtgagtttgtgacagaagtatgaaaggagtgagcttgggggaatggggtgggcatagactggtgaatgggtttttttttttggttgtttctttttttttttttttttttttttactttttcatttatttcttttgattaaggggagtgcaactttctccagtgccaactattaccagagctgggtaactgttggaagagaaagggccacccccagagctcctgggtgaaaggcaggttcaagtgaacaagtatcttagctgaaggagaagcacagtatagtggaaactgtgctgctttcaggagaagacttcactgtgccttggctttttgcatcagcaaatggacagaaaaaaaccaattattcttacatctccgggatatggtaatcctctctccttaagaccagctctcctcct

SEQ ID NO: 17252 - DNA, 1999 bp, Homo sapiens
cagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctca

SEQ ID NO: 17253 - DNA, 2195 bp, Homo sapiens
gtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaacccaggagtcctggccttgcttcccagaaccctctcagaaggccctctgctttgaaaaatagacaaaaggggcctctggccctccgtactgtggaagaccctcaaaggacagctgggctttctcagcacacttttgtcctgggagctgcgtggctggttgcccttgaattcccacacattgcctacttctgccagggacccagcaggccatttgctcttagcagagggcttgtctgccgggcacgtttgctgggctctc

SEQ ID NO: 17254 - DNA, 1512 bp, Homo sapiens
tccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtactttgctttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacacc

SEQ ID NO: 17255 - DNA, 1251 bp, Homo sapiens
tttacaagactcctctccccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacaccttgctcctgcttctgctacgaccttctggggaacgcgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggtccgcttctcttacagtgtgatttggatcatggccatttctaaagcctttgaactgggattagttgccgggctgggccatcaggaatttgctcgtccatctcggggagacctggccttcagagatgacagcatttggccccaggaggagcctgcaattcggcctcggtcttcccagcgtgtgctgcccatgggaatacagcacagtaaggagctaaacagaacctgctgcctgaatgggggaacctgcatgctggagtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagctggcatctgcctttctatacaaagctactattaatcgacattgacctatttccagaaatacaattttagatattatgcaaatttcatgacccgtaaaggctgctgctacaatgtcctaactgaaagatgatcatttgttagttgccttaaaataatgaatacatttccaaaacggtctctaacatttccttacagaactaactacttcttacctctttgccctgccctctcccaaaaaactacttcttttttcaaaagaaagtcagccatatctccattgtgcccaagtccagtgtttcttttttttttttgagacggagtctcactctgtcacccaggctggactgcaatgacgcgatctcggttca

SEQ ID NO: 17256 - DNA, 1226 bp, Homo sapiens
tccagcaaacacatgaatggttatttcctggagccggaagcacttgggggtcgtggtaattcccaatgttttctgtgtcctagttttaccctttctaaacactgtcctttttgaaagtttgaatatatccacattgtattgaaaccttgaaactaaaaatttagactcttatcgtcatcttaagttcttcatgatactcttaacctcccaaaaagcagtatctaagtcacatacatgatgtcttgggcattttctctctcagccatggagagctgtgaaaggaagaatcgctgcttttctcaagcaaatcggtttcttgatgtcttttggttctcactccttgcctgttcctgatgctttgaccccttttatagatcagagtgctctagaataatggatggtcttggatggtggataaatagggacagggacagttaaattgggagcctttcttacaaccttgataggcttttttccccccaagtttccttctccactgaaatgccacactaatgcttgttggattcatgaggtggccagaccaacgtgttttttttgtttttttgtttttttgttttttttgtttttttgtttttttagcttcccttgagagaataaacggtaatggagagaactatttaacaaggtcctggtttctcttgcaacacagtagctaaacttgcctgcttttatatgcatttctttgtagggatcagcttgatagacagtattagcagagaaacgacaccttgatcttggtttgcaagcccttcccccatcagtcctagattaggccctgctcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaaggttttttttctttttttaaaaagaaaaaaaaaactattgattgtagataatgaaaagctagggtttgccctcttcatgtctactctccttccaaatagttatatccaaaactgtttttccctttcccctaccttgcccccctattaaaatagaaacagggattgattaatgtcccactcctgaatacacgtaaaatttgtacaaaaatatcttccatgaaaatgatttgtaacctgtagacttattacctgggagatgtcttgat

SEQ ID NO: 17257 - DNA, 1501 bp, Homo sapiens
ttgtactatcaaagaccttttgcttcaatggtcatagcagcattaaccatactaccccaaagtggaaacaacccaagttttcatcagctgataaatggataatcaaaatgtggtatatccatgcaattaaatatttttggcattgaaaacaatgaagtacccttttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacgatgacctggaaggagatgtttcgacaacttggcacagtaacaatgacgatgtgtatagggtgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggatgttgctgatcaagcacaggataaagacagggatgatcgttcttttggccgtgatagaaatcgggattctgacaaaacagatacggactggagggcttgtcctgctacagacagctttgatgactagaagaggtgatgatagctttggagacaagtatcgggatcgttatgattcagaccggtatcgggatgggtatcgggatggcccacgccgggatatggatggatatggtggccgggatcgctatgatgaccaaggcagcagagactatgatagaggctatgattcccggataggcagtggcagaagagcatttggcagcgggtatcgcagggatgatgactacagaggaggcggggaccgctatgaagactgatatgacagacgggatgatcggtcgtggagctccagagatgattactctcgggatgattataggtgtgatgatagacgtcccccccaaagacccaaactgaatctaaagccttggagtactcttaagcaagatgattcctctgctagtacctcccagtccactcgagctgcttctatctttggaggggcaaagcctgttgacacagctgctagagaaagagaagtagaagaacggctacagaaggaacaagagaagttgcagcgtcagctgagtgagccaaaactagaacgacggcctcgggagagacacccaagctggcgaagtgaagaaactcaggaacgggaacggtcaaggacaggaagtgagtcatcgcagactgggacctccaccacatctggcagaaatgcacgaaggagagagagtaagaa

SEQ ID NO: 17258 - DNA, 1118 bp, Homo sapiens
aggtgaacatcacacattggggcctgtcgcggggttgggggcaaagggagggagagcattaggacaaatacctaatgtaggtgacagattgatgggtgtagaaaaccaccatggcacatgtatacccatgtaacaaacctgcatgttctgcatgtgtatcccaaaacttgtgtaataaatataaaaataaaaatagctgcatttttaaagcactcatgtgttcatagatgcttgctcaacactgttttttcaccactcccctgagttgtagaggcaggtgggtactgacaaatgtctttatcagtgaaaggtgtctccgagttgaggtgagagctcttttattttagtctttcagggatcactttccctctgaaatacacttgacttaaaatgtaacaagatggcatatttactgaaaggaataatgcatcttaagatctgtcagatgatgataaactctgtgctctcctggataatgctcagattagttcatattccctgacactgatttccctgaagctttagacatgtcagtgccaagaaaactgtcttcccaaatagtacacatctataaattaagagtaatggggtgggtttttgttctttgagactatttttcctaaatttagtttcaagaattgataaaccgcttgccccttctgttatgttagtttattatagtcacatgtggaaactttgtaatctatttcactgaggcatttaaaaatattctgccttttacatcatagaataccaggagatgctgaatagatatttcagtatttttcttattagaaatcatagtgtccattgtagtacattttgaaaatactgtggtataaagaaaactaaaatcacctctatgatcactgtatactttatatattttcttacaattttgtattttacaaactatggattatgctgtataatttttaaatcttttaacaatacaagcattttttctttaaatatttgacagcatgattttcgttgcctgtatagtatttcattacgggtatataatttatccagttccctgttgttaaatactatgtgcaatgttttttgcttttaaaaatactataaaagacacctttgtatacaggtcttttaga

SEQ ID NO: 17259 - DNA, 1201 bp, Homo sapiens
ttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgccaaaacgagtgggattttttctttttgcattttcatgtcagcaaagagtaccggacatttgattgtttcaacatgttttttctctggcattttggttgcaaaagaatgtgaatttttagcatgaactggtggggagtagttgcagggccacttgagatgttatttaatctagagtcattgcagcacatactaccatatctacgccttttctccagaaaatgttccttttatgttgtatgtgtgtgtgtgtttttttaaagcatttataaccctcttatagaacttcagacttctcattatcctatactttcaatagttgtaggagccaagggaaaactccttcaccctctaaaggttcaccaaaaactcagctcacaaaaggcagataaagagaaagggcgtacaaattttattaatgtgtacatgggaaccttcagaatggagacccaaaaatacagggga

SEQ ID NO: 17260 - DNA, 1157 bp, Homo sapiens
cacctggggcttcaaggaagcatgggtgagaaaagcaaagcaaaaaggttaagcacccaactgcacctctgatgattaggtgcaacaccccttcagtcggttgtaagatggacttagtgtgtataggtattaaaaaggcaaataataatgaaagtaataataaaacaagaacaaaaatggagaatgtggctataaaagatggtgcaaataagagtttcactctcctttctggggggcaggggcagtgagggaatcatattctgtgtcacctctgagagcaaggaaattacagatttctgttgagttccagaacagatgattagggcttgacttagaggcgagttgtaacttgttcttcctgtccatcaccccatttgtgcatgagcaagtcacaagcctctccccaagtttcaaatacatcctctgaggagtctaaaagtttagaatttgaggagcagatgctggatgcacagtgaagagagctggaacaggctagagggcattcactgctctgagcagcgccctggacttcacctaattctacctcactgaggttaatttcactttgagaacaggcctctgctttccctttctccatctgagaatatctgatgtcctgccacatacagtgctgctgaacaattccatcagaaattgtgtacattggctctgaactgggttcagacatatgaccattaaatttggagaataggagacccagtttcttgagagaaggacccatgaaggagcgtttgcttgatgactcagcttttgactttccttgggcaccactggaccttggcatggttctgatgagaggtggcccatggcaagtctttttcttgcagcctaaattaaaagagacactcttggatttggcccgagccccaccactgccatcattattatcgtctctctgagacagttcagtgctgctagtggaaaagctccttggatgttttctatttcccaagaggtcaagcacttcataccgaaagctggagatgtcttgctttaattcctgggaaaagagaggagacatattatgtcaagaagcttggtctttatttcaaagtaggcacattagatacctttggtatgttccaggtttttgcctagtagcaaatcacaaaacaccagaaaaatctgccattatt

SEQ ID NO: 17261 - DNA, 1195 bp, Homo sapiens
tggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataaggagtaaaaatgcattaccatttgtttaataattatctttacagaatgctagtttaatgacttttttaactgaattttttgaataaatcagaaatgtttgtattggtcacagatctatcataattgcttttctgatgcatttaaaaataaatggaacacttaaatgtatattaccgatgcaaactgtggataaagttgaaagaaaaaatttaagtctggtatttcttttctccctctctacctcctttcttaccatcacatcatccattttttgtcagcatttgatagatggtgtctgtgttccctagtgtagaaaaatagccagactttgagggaatattcaaagtaagtggtttagaggtccagattcactttatattgtgaaaggaaaataaatcttggggccccaacatcactaagctaaaggagaaggtcaagctgggaactgcttaggagaaacctacctccagttctattcaaagtcatcactctgctcactgagataaatgcctatctgat

SEQ ID NO: 17262 - DNA, 1277 bp, Homo sapiens
ccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtat

SEQ ID NO: 17263 - DNA, 1181 bp, Homo sapiens
gagaagaaagatggaacatttacgggaagagcgagagcaaatacgacaacttcgcaacgtaagtcagattgctctttcagatctgctttgtggaaatgggtttaacttggaaaattaataaggcgtacagatttcattttcaatgctccttaaaatgtttggatatacaacaattagtaatataaacatttaacatgtatgtttagatagagtatctgatttatacctgtttttctatagaatcttgaatccaggttaaaagtaattttgcctgatgacattggagctgcactgatggatggggttgttctttgccatttagccaatcatataaggccacgttctgttgctagtattcatgtaccatcaccagcagtggtaagttttgtttacaatttgttagttctctaaaggaagatatagcttcttaaaattgtctttaaataatatacctcagtgaacttagttttcagttttgattaagttccatagaaaaatgcctaaaagtacattttttccctcttactttacagcccaaactgagcatggcaaaatgtcgaagaaatgtagaaaattttcttgatgcttgtaaaaagttgggtgtctcacaggtaattgttatttatctaacaacgtgatcacttaaatttgaatttattacatgcaaactggggttcttcttagagcaatgaataatgctttctgaacatgaaaatgaatgccttctcttggtaccttctcctaagctccagctttcactgtagcagttatctaatgaatgtttttaagctacctttaaagtaatttataaaatagctacaaatatggaaaatcatgcacatcactgaccaaacataactcggtggccatatttacaacttggttgtgatgtcattgttaccatctttttttccttcttttttttttttttttgctagagaacatttggaccccattgtaattcactggatagattctgattggaagatttgcattcagtgtgaatagctttttaaactttatttaaaatgcaaaattggaaattataccagcatattatgataatacctgtattggacaaactttgaaatttttaggaattgtcttatgtttcatgtaataattgcactactatacaataatcattaaagcagtattgtaaatatgtaaggaagatatat

SEQ ID NO: 17264 - DNA, 1836 bp, Homo sapiens
attatatatgaggaaatagatgtcttacgtggtgtccttaactgacaagaatttcatcctgattttgtttccccctaaaataggtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataattagtctgttcttcatgcttttgtctcttaggaagtatgccaatgtttgtcaggatttttttctttttgtttttctgatgtattctgtaaaatggtgtttgttaaatttgagttttgggagctgaattagaggtactgaattaaggacagtacaaatgaagtaaaaaggttttctccaatttaccaaaatttctttatccagttcctgcttttttctttcttttccacctccctcagtcttttcaatgttctatgatatacatatcctgaaacagtggggatctgaacagtcacagaggagaaatggttcatagtagatcttctcaatctcatccatatatgacatttttggctggataactctgttggggtggggagaaggggctaccctgtgcattgtaggaggtttagcagtattaccggcctctacccactagatgtcagcacatgcccggtggtgttgaccaaaattgtctccagacataaccaaatgtctcctgggtggcaaa

SEQ ID NO: 17265 - DNA, 1879 bp, Homo sapiens
attcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtcattttggtctgagacatcccattattgtctgatttgacttcctttgattaaatatctatatttttggcatggcaaaatgtgatcagaatttacagctctgagcagcttggatgagtgaatatgcctttttattcaaggaaaaaaagaatttgacaaaatctaaccttattcatcaaaactcattgctggttgtgtttggggaattagattatggaagatgctaactggcttttcatcaccacagaagaactgccagccatatctaaaccagaagagcagttacaattccgagtttagtctccctgatcttcaagaggatccatcttgcctgatgagaagggattgtgtaaaattaccttagagatttgtcgacctgggatcccaaaggaaaaatgtttttgtgaaagattatttgagaattatattagcatcgtattgtgatcttctctactttatctgcagatgatcagattaaatctgagccaaaaatttagg

SEQ ID NO: 17266 - DNA, 1239 bp, Homo sapiens
actggctgcaatgatggtgggtatatacgaactattagctttaaagtataaatgtagagaaattattatcagtgtccattttgtagtctgtatatgaattaaagcagtgggcttcagaacataaaccaagaagtgtgtatattttcattctcaatgtaaaagtttgcttcttatgtattaacgtttgtttctatcaacatggggacccagaattgaggagtttttcatttcttttgatttttttcatcctttcttcctatgtttttagagcaaagaaaatggagaaatgtcaaattataaatatgtaagcagattacagaataaatcttagtgatttctgcaatgacagaaatttgttagattcttacactatctagtctaatgtaacatgtactaatggtttatattattaatatagtctcaataattactgtaagagctcccccaaagtcttacacatatctatcatagctataatagatatgtttcaagtgtttggatattattactgttccacttaagagaaaaataattaattgctaaatttgaagttaaaaataattttcttttctttttttttttaacagccacagtagaatgttacaatccaagaacaaatgaatggacctatgttgccaaaatgagtgagccccactatggccatgctggaactgtgtatggaggagtgatgtatatttcaggtaaacaagtatcatgtgaacacaatataatatataagcttttaactatatggttatctttccatatagtggtagtaataataataataattcaggcgtcaggagtttgagaccaggcgggccaacatggtgaaatcctgtctctattaaaaatacaaaaattaactgggtgtggtggtgcacgtctgtaatcccagctacttgggaggctgaggcaggagaatctcttgaacccagaagacggaggttgcagtgagccgagattgcgccactgtactccagcctgtgtgaaagagcgagactccatctcaaaaaaaaaaaaaatccagaaaaacggagaatcaaaatataatttatgttgattttagaaactatttttgtgtgtatttgcatatgaatgtcttgggcattctgtaaatttataagagtactagtaaaccaatcctgttgtaaggtataacttagaaaaaattggaaagcattcaaattttgctttccagtccccatgctctgtattctgataaacaccattcatagt

SEQ ID NO: 17267 - DNA, 1883 bp, Homo sapiens
aactttgaaggaaccaaaatgaatgatagtaatgagtgatgcctatttacgtgaaagggaaatctagggtttgggtattagagcttttctgttcatggatctgctagctgtgtggtatttttaagaataatgactaagaagtggattgagatgaatcataatagaacaaccttctattttcccaagtttccatctggcaggaattttatcagtattttgggggtgggggtgggatacatttttgaggagagaagagtaactggtttggccatattccagttataacattgtttcttagagtagcttctaacttactgactttgatcattttcttttagtcagccttctagtggattaagtaaaggtggtttgcaaattatctgtttgtagatcattgatacatttagataagaatcctatttgtatctatttgaacattaaaagcataatttactcttattctagaacaggtatttgtgctatcaagatgtgattgccatgaaagtagtcatgttttaattttttttaattggcttaataggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcgtaagtgcatttatattaagcatagagacaaatttcttcactcagaaattcttatcaaatcataaaataagcagtcctgtaaaatcagataaaaatgtagttagggttttattttaaaactatttttctgagaaaatattgaagaccatctttatgccttatctgggcatatatcgttggcaagggaacaaattgtacgttacaaatacatcagtatattgtagcatatttcacctgtgcagtatatatggtcttcatcttgaaggttcatctaaagagtatacttagctcatttaaattataataaggtcttggatagaagtttggcatgttttctcattttctgcttttaaaaggccatatgatattttactgaacaggttacaatccttcattacagaaaactttcattgtttcttcttttacaaaatatgttacctattagtggccacaaagataattttctttatagattaaatgtacaaagttcaacattatccaaagtttgttcactgtgaatattatgatctatgactgttttaaaaa

SEQ ID NO: 17268 - DNA, 1997 bp, Homo sapiens
aagtctcaaacttgaaacttgaaagatatttggccaggcagcagcaatgtactgagtataggcttctcaaagagatgaagtaatacaattagtagaaagaactatcgtgtacttaatacagttgctctctacttttctttctcaacctcccccaaaacaaaacaaaaccaagatgcttcagtcaagcactataaaaggactattaaattatcgcgaaaaggaatgttaagacagtctaatactctcattctgcagatgggaaagtagaagtgcacattgtaattatttttcaaaataaggtaaaagctgataattgtgtaaataagcaaaagtatatactttttccttaatcgtttttaacctaaattagtcttaattttgtgttattcctacagtgaaagaaaacatgcattgtcacatatcaggaaagttgtgcagttattttttcttctcccgaatattctgttggctttatgttccacatatgttgcaccacattaatattcaaacaattttagcacacgaagatttgtaacctcattttaccttgattagtgactcaactcatgttcttgttgtagggctttgaccagcttcgacttgaaggattgctttgtgatgtgaccctgatgccaggtgacacagatgatgctttccctgtgcatagagtcatgatggcatctgctagtgattacttcaaggctatgttcacaggtagtttgccttttaaaactctgaaaccacattaaaacaatatgaaaaatccgtgtttaaatcttttttatttctaacatgaaatttggttcttttggaaacagcttcaaaagaagtacacaacagtatgtatggttttcggtggtgctgttttaacatggaaaattgatgcacttttttcatactgtccatctttatctcacagcttttctttttcaagcttatatctagtgggccatcagagactctgtgtcctcctagtacaatctctactctatgtcaaaaaataggaagtgagaacattttggaagcacttgcatcatatatgacctccattagtatagagattatcttttttaagtactttcttttaacagtaaaatgtgcagcagactgactctaatatgactgcttatataagataagactttcctttgattttattgcatctaattagcagcagaagtgagtttgaccataattatccaccttcatttaattgaatgtctttttatttaaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtaagatattttgaaatctgatttttcctgtggtagactctgatgtagcctgtttaggactcatgaaatctgctgtgcaggaatgtgaaacttgccattagacagatgtgtcttgttgtatgtggtctgtaagcaaggtgagattgaaacaggtgcatttttatgaaatagaatcatttaataaaagcctctgtgttggccgggcatcgtggctcacgcctgtaatcccagcactttgggaggccgaggcgggcagatcgtctaaggttgggagttcaagaccagcctgaccaacatggagaaagcccgtctctactaaaaatacaaaaattagctgtgcatggtggtgcatgcctgtaattccagctacttgggaggctgaggcaggagaatcgcttgaacctgggaggtggaggttgtggcgaactgagatcacgccattgcactccagcctgggcaacaagagtgagactccatctcaggaagaaaaaaaaagcctctgtgtaatcaaatgacatgagatactaataatgtttgatgaagatatatactttaactgtttgata

SEQ ID NO: 17269 - DNA, 1164 bp, Homo sapiens
gcactttatcattgtcaaactgcctctctaaaataatgcctaaatgaatttacttcttctttttttttgtcttttttttagacggaatctcactctattgcccagactggagtgcagtggtgccatctcggctcactgcaatttccacctcccaggttccagcgattctcctgcctcagcctcccaagtagctgggactacagacgtgtgccactatgcccggctaattttttttgtatttttagtagagacagagtttcaccgtgttagccaggatggtctcgatctcctgacctcgtgatacacccgtatgggcctcccaaagtgctgggattacaggcgtgagccactgtgtccggtcatgaatttacttctagtatatatccactgtaacttgattctcttataagacacacaaaagcaagtatgtacttacctttaataccttcccagaagtcattacgatctctcctgactgaagtaaacttgcttaggtcatggtaggtactccagatataaacatacttatcttctgaaccactaacgaggtaagtaaaatcatggctgaattttggggagaaaggaaaagcaaataaaatgtgtgtgtgtatatgtttaaaggtttcctttatcagtgcttcctactttgtgatacctaaaataacacttgaagggtcttgttgaatatgtagacccatggtctcactctagatgttctaaatgtgtacgtgtgatgtagtggcctggcacttgtatttgcatcaaagctctaagtaactgtgatgttagttaatccacgttgggaggaatgatgatttaaggtgtgaaagacaggagcagaatactttaccaattgaattaattaatgtataattcaagaaaaaagaactggtaagaaaacggcaaaagaagagggctagaaagaagaaaaggtagctaaccctatttcaggagagtgtccagaacccaaattagaaatttaaataataatgatatgtaaagttttgaatacaagaccctgtgctgtggggtgttaaaatgctttcttagaatcctaaaaggttccttcctttcctaaaaggttcaagacaatggggcagggaggggagtggcgggatgagccgtaagccccctcttaaaagcgtaaacaaaggtacaaaagca

SEQ ID NO: 17270 - DNA, 1150 bp, Homo sapiens
ctctgaggcttagtattttttcacggtcggggtattgagtttatcattggtaacacatcgtaagatcaaaaggcctccattatttcttaggtgaaaatttgcacctgtaccaagttagcttttaaaaagtgacttgccatgaactaattggaagcataaatttaccgttatttccctgataccaataaaaatttgcagtgaaagctaaattgctgccacaggagggaaaatgaaatggatttctttgcagagtttaaatttgtcaaaattatgatgtgttatatttggcaaatcactcgacattgagaacgaaatagcactccacgtctggtatgaagggttccactaaaatcagcatcagactactcagtcttgtctttttgggttcttaaagttgtcatgtgatttttttggtcaattactaagaattatgttttttaaatcgctctttgagaatgcaattcatgtatattttttatacatgcaggaatgtgttaatgattattaaactgaatgatctttgcctgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggtaaccatgtaaactatacatttttggagtataaaatgttatttataatctgctaattgtgtgactcattttgactgattaatcattttaggcaaggaacattgcagtctgtgtggaattccgggattcagatgaaagtgacgctagtgccctaaaggtttgtttatgatattgataggcatatgtttttagtagagatggagattttggtactcagtagtcttatgctctaggtttaatttgtatcaacatcaaaaagaaaatgttctaaagtgacaaatgtaatactttcttttctactcttacatattaactataaggcttagtttaaatattaatgcagtaggagcatatatagctttaaaaatgccaggttttggcttttgctcctttttgattttgcaattgcttcaatgccca

SEQ ID NO: 17271 - DNA, 1097 bp, Homo sapiens
ctttgggaggccgaggcaggcggatcacttgaggtcaggagttcgagagcagcctaactaacatgatgaaaccctgtctctactaaaaatggatacaaaattagccaggcttggtggtgtatgcctgtaatcccagctacttgggaggctgaggcaggagaatcacatgaacctgggagatggaggttgcagtgagccgagattgcaccactgcactccagcctgggcaacgagcaaacctgcgtctcaaaaaaaaaaaaaaaaaaaaaaaaagggaaccagataatctattattttacctaagtactgcctttgcttctagttgcatgggtgaaatatttcaatgtatggggagaatatagggtgaggagtaagagtaagccctgatttagcttgcttagtgctagtttgagtccttcagtggcaggacagcctgtaaagtaccacaagtatgggagtgttataatggcagagtgaaacgattagagcagggaggaagtgaattgtgccattagtaccttcatgcaaattataccatgtgattttggacagtgaatgatttttgcatcattcattcacagcccatcactctgttaaggtgagagtgtaattcttacttctcccatcaccacctgtagctagaaacaggaaagggagaatgagatgatccagacaacataaaaaagatgcatgtaagcagaaaccagatggtcttttctgcactcacttaatggacattatgttgccagagtgttgtgtttatcagatttgatgtttggagctagtctgggcaggtgaagaacagaaataggcggaagtataggcattatttctgcgcaagcaaactccacaaagctcagggagcagaaaagactccccctcccacctggttcccagaccatgtggtcataacacaatcctaatagtttctggttatctagtgtaaatgcaacaaagaaaaaggccctaagcttctctacttattagatatattatttttggcaattgatttaacttttgccaaccctcagttttctaatctatgaaatgatagtgataagttctgcatatagggttgttacgaaaattaaatgaga

SEQ ID NO: 17272 - DNA, 1905 bp, Homo sapiens
cagcttgggaatgaagggtatacagaagaaagacataaggctaaatctaggccagaaaaataagacttcccccacagtagatagtgccacttatttagttagtttttctgtctatcatgactgacccagtctttgcctagtaggttatattttgtatgtatgtatgtatgtatgtatgtctttgtgtgtgtatgtgtgtgtgtgtatgtgtgtgtgtatatatatatatatatatatatatatatatatatatatatacactaggtagcaagcagacatcatatctttctgctttgtactgtactactgctgctagcaaataaccagcaaaatgtagaaaatgaaaaaccaattttctgtagacaacctggagaaaagagtgcctgcccctgacttagcggggcagagaatgacaatttttaaagtttgccttttctgaaggttgcttttagcccagtgctgcctcagcagcaaggggcaagcagagtcattgcgcatgtggcgcttccagctctacctgtggagctggcctgggctcagataatcccctgtgactggccattggagcggcggagctcctgaggctagttcacagcacccagaggtctcttacagtcaacagattgcatactgttgacagactgcaatccgtctgtgttccccacaccaactccatttccaagatgggaattttattcaggaactcatttttgagttcccaacatgttgacttcgcatccatttctgctcaccaaggcagaaccatagcagtggtgtgtgacaaagatgcaaatggagggcagcccaaacaatggaaaagagaagattttcagcccattcttggggctaagtgaggttttgatttatggtagaagacagttctaaaaagcagctggcagcatgggcttcaatttgtggcccttctgagttcaaacagaaggaaggaaaaggagccacataaagtgtacacattcaattcatcttagaatgatagctcccaccttattacactgtacaactatttaataatctgggttacacacatccagaggtgaaataaagaaattttcacttacaaatgtgtatttccaaacatgctaagttaacctccagagagaagtgcctgtaatctctgttcctggtgtcactttaaagcttttgcttcatgactgtagctgttgtttaaaatgtttttgcagcaaacgcgatttaacagaagtttacaaagcaacactgtagctaatgcataattttaaaagttgactaacatttatctattgttaaagcaacactaataatggaataaaaggaaagcaaataggccaatgtggcaccataggcttattttaggtaaattagttccatcatcttatgcagttgtaagtaatgccaggattaaaatatcaagcaagccacgtaaacagtggcaaatgtgtgtgtgttttccatttgtttggtaagcagccattttactcttgcactgtaatgaactgaagggaaatataagataatgcttttttccccccatattgctattcaactacctctatatgcttgatttctttttaggattcccatcctccaaatctgtacaaaaacgtttcagctcatctgtgttgtaataacaatgtgatacagacagtttgtgtgaaagttgtttgttcattaaaaaatgtttcctattgcctcactttgtgtccaacaaaactgtattcctaccttaggaaaagaattatccaactagcttcagtatcacttcggtggaagctgaatagaaaggaatgcttcaggaacatctatttgttcttgttcctattggttgtaataccagaagatcctttaaagaaatatacttgcattcagacagcaaactcccatgtatgtgacagcgaggcaggtgtgaac

SEQ ID NO: 17273 - DNA, 1715 bp, Homo sapiens
gccagacgttgccacctgttttatatgtctgtcttctgaacaaaacaaattccctgttggcaaggacggtggtataaaccacctttgtatccttcaagaagcccaacacattgctgagtatattgcaggcctctaataaatgctttaaattgaaacgtggtaatgatgttttagaaagaatgagaatgaccatttgtgttttcttctctacctccagtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactatagtgtggtgacttatttaaatttttttaaaaaccttattctagggaatctgattcagacattttactttggcttaaaattcagtttcatttttgagtgcagagtttttgtattccaaaagaaacaaggggcaaaatttcatggagaccccacaccaaaaaccaaataccagcttgtcctgt

SEQ ID NO: 17274 - DNA, 1584 bp, Homo sapiens
gaagacagcagcattaaaaacttcagaacctgtgtgttttatatttcccaaagcttgtcaatacacctggagtcattttgacctatgctttcaactttggcaagagaaataataatttgtatttgaccctgctcaagcttttaaatgctgcttgatccaaggatagacatttctatggttcagctaaaactttacttctacgccagtgaaggagcagattaacattgagaggggttgagatggccctctatggctccttaggtgtcataacatcatcatttagtgtcatttatctccaaagacgacagcagtgaatgaataatgatccttttacatgttctttgatttggtcagaaacaccacgtgcagcaacaaactttcctgacttttatttagaaataattgtagataaaagagacgacagttagaacatagacttcttcatgacattaaagagttgcatgagcacccaccaggagaaaattaatcttattactatgtttaaatactcaaagagttgtctttttcaagacaaagtcttggaagaagaatctaaaagtggtccagattgtcctttgaggtttaaatggatagtatttaaacccattagcagagttgttgttttttttttaagaaccccatgtctttccattttagaaaaacagcaagattgaagtaatataaccactggaatttgcaaaaggaaatattgaaaaattgtggggcaccaatgatgtcacttgaaaaaagatgctgtgactattccacttcaggttatgtaaccctttcactcagggctggattacatcagtttgtaaagtcactgaatatcccccaaactgaactttattaaacagtaacaagtgcctctcttctcaatcctcagtgatgccatcaagttttcaaaaagagtaaagagaaaagcctatagttttgtagctagggaaaaatgtatatgtgtaggatttgtaaactctcaacataagcaattgatctttttacctactagtttttgacttcataaatgtttttaaattgaaatattttatggattcttaaagacttacatcttagtgcagtgcatgttttatagaaagctccgctgattcattctgccttaccttgcatttaggacctcaggggcaatcgattaccttttttttctccaacaaaactatgcctgacctggtaattgaagacattaatgagattagagactgtcagcaacaggaaaaagtcatttttaatccacagaagcagtaaagggcaacactttgatgtgacatgattcattcaaacactcttaatttgacattctgtagaaaagtaccagctgatagagccaggtagaatgccagtcattgtggttgcccagaatatcacaatgtgtgcatataaccagccttttgagcaaacgggtatgtgaaagggctacaaaagcttatttatctgaaggaagagccacaagttgtttcatcgatctcttctaatcatagagctatgttagtacatgcaagaagtcagaaatgaatgtaccatagcagatgatgtttattattaataagataataaccagtggatgat

SEQ ID NO: 17275 - DNA, 1229 bp, Homo sapiens
agatccatgaaacagatgcattttttgactatcttttcaattattatgaacctccacaatatactcgtatctgcctagaaacaagtcaggtagcaggcacatgtcagtggcagagggatgtccaagctaagggagatggatttcagattaatttgagaaagtgtaggcatcactcaatcaattcgagccaagtagaaaacctggaaaggaaagaacaggttcaagaaaataattactcatcaaagatttgtactcaggatcctgagcgtaaacgaggaaaagtagattatgccaaagaatgtactaatgggtttgaaactcattgccaggagacagcccataaagctggtggtcagctgtccccaactgatggaaacagctgtctgttggaaaagactcatagttatcatattgaagattccaaatccacaaggaaaagccaagtgtccccaccccatgagtcaataggcttaggtttacagttgacagatttcttagaggaaattagtagtgattctgaatgcttcagtgaaacccttagtataaacaaagaggagaaagagaaatctgtggccacatttaatagtttctcagaaaaagaacctcttgacactgacaaaatgatcactcgcaaacaaaatacaaggtcgagtcagcagacctttttttcaaagtggaagcgtgatggtgaggaaaaatactctaattacaagtttaggacaccaggtaggaagtctgagtatgaaccgagatggatatgttcatggcctaggggtgaaagtcatttcattagacatgaaaacaacaatggacaaatgaagggacaactagcccccagatacttgtttgatgaaggctactaccaggaacccagttccagttatctaaagaggtttagtgatagtacattggaccagaaagtgaactatgggccctctcaggtgcccgtaatgtcatcaagaagtgctaggtctttctattttggtaattttcacggaagaagagggactccttggaagtcagaatataaccagaattcaagatttagaggatgtaattataactatttgaagttcaattctgattattactataatagacataatggtcaggagtatattgactatggaagctattcaggaaataactgcactggttctttaaattttaaatgttttgatgaccacttagatcaggagtatcctttttcacaataaacatgttacaag

SEQ ID NO: 17276 - DNA, 1102 bp, Homo sapiens
ggagacttttcctttcctttcactttaatagtgacgctcatacagagccaccttgcctaagggatgtccagacatctacctatatttgaaaagcatcttttttttttttttttctgactgctaacgcaatgctactcagttagaagaatttggttcacaaaggggccagacctaaaagtaagatgacagcagagagttgaaaatacaacaaactaaaggtaaggctccactcctctccactaccctgaaggcttagaacctagcagtgtttgtacctctggacaggtaatttgactctgttaggcaaatagaactctgttcctactaagagtagatgctatgccaaccgggaaatattgaagtaggcagaaaacctggaactttgttagcacctcctcgcagggatagttataacaatttactctcccatcctggggctttgcttctgctcccagccctgccccctgtggtaggcgggctttcttcccagtccctctgagcagttgtcgttcaaggctggccaaagacctgtgtctactgaatggtctatgcctgtggctcactgctcattacggcttctcaagtcaaagcaacaagtagggctttccattgccagactgccagggactaaagcagaccccaggacagcccagttttccaaagattttttttttttcctctctctaacttgagttaaccattccctggccaaagccaggctcgttatgctctgagtgtttgtgtcctcccaaaattcatctgttgaaatcctgactcctagggtgatggttttaggaggcagggcctttgggaggtgattaggccatgaaggcaaagctctcatgaatgggattcgggtccttttaaaagagatggaagaaagctagctcccccttccaccatgtgagggcaaagcaagaaggctctaggaagctggccttcgccaggtatcaaatctgccttgaccttggacttctcagtctccagaacggtgagaaatacattttggttgtttataagccatctagtttatgatattttgttattgcagcctgaacggattaagacaaggctatggcctctcagtttctgagcttgcaaa

SEQ ID NO: 17277 - DNA, 2546 bp, Homo sapiens
gcagctcaggagacttgaggcgtaggctgcggtccccaaggtgaccgcgccctatgtgggactcgccctaatgcctctgaacctgggtttgaggtaatgacctttctcctaggtctgaaggtcacgggtccgctggaggatgccccctctccactcagaggggtggaggcttaatgctactggtgcagatcacctcttcccctgtgacagcctcagagggttgggagggtccagccagtatgatatacgaagactagatttgagagaggggagcctaccttaaagggcattgatcgagatggcataagctcttctctttcccttccccatggttataactgtccctgttggcttccttcctgtctgttaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggctctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggtaagtttgctgtgggctttaacgttgtgttcttaggagacagtttaaaagagcattgtaccaacctaacagtccaagagctaaagagttgtttttttaattgctaaaggaagccaagatcatccaatgcaacccttgtgtacagatgacgtgtttaggggatgtggggaaaggaagtcagtaaaactctgctttttggtaaaagcatctctttcctattcccaggaatgcttccggatcccaagaacactcacatcgtcatcagctggatgatcgcacagactgtcactgctgttgccgggttgacttcctatccatttgacactgttcgccgccgcatgatgatgcagtcagggcgcaaaggaagtaagttccacttgagcagaagataaagttgtagtcgtggggcaatctgctgccacaaactggtgatacatacctttaaaatggctgtctgtccaagtcaagggatggggttgatagcatctgtgtctgttccacaactgcctttgagctggcccttcagatgcctatgaatgagggtgcttaaatggtgttagaggttaagaccaatgggtagtctgtattcctgtggtcatagcattaatatttcagtgttgcccatgctaatgtgtgaatgttggatttaaagctgacgttcttagaggtggggctctgctttatttagcctagtgaatcttaggatttttcatcggccttcagtcactaactccatgtctttattctttgcagctgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaattttgtctgcagtatattttcatataaaaatgcatatttgagtgctacattcgaataaatactacctttttagtgaatgctacatttttaataaatgctacagtatctccggagatgaagaactgtctttttaaaaccaattgtcagcagtccgcttaacagaataacttggttgtgccacccacaaacatttccaacacattagcaaaggaattcaggcccagtgcatccaaaaaacattgttccattgcctatggatgatcatagctgaatgagctttctccaagaaatactgtgaacccaccttctctagtcctatggttattaatcatgagccatgagctgaattatccactttaaaatggttacgtttgttgcatgaatatcacctcatttaaacttttagaatcaataccaatttcatccagttgccttcattttcacctggctcaagccattttttttttttttttttttttttttttgagacaagagtcttgctctgttgccaggctgg

SEQ ID NO: 17278 - DNA, 1256 bp, Homo sapiens
gttgtatatatagatgttattttatgtcacactgcttcaatgatacctatatccatgtgtttgtatccatgtttttatccattcaactgtattaaaaggtgttgggacaggagttgtgttaaccttcttgtattatctacaaaaagttgcacttagtaggtgcccaaggcaggttcgtgaggtgctaccgggagatgatagtaggatagtagggcaggtttttttttgtttgtatgtttttgtttttgtttggtttgtttgtttgttttgctttttttctgatctccttatttgcaaggcaaagtaggttagatgtgagctagcaagaactgggaaaaagaggggtgggggtcccaggaaggcccaggatggggctgtgttaccttcttcccagttattttcctgtatccagtgaagtcttcgcaaccaattcttcctctctaccttgtttcccgtcctcattctgagagataattaaccgtcatgtggatgagaaaccataaccttacagttccttaacctcaactccagacagtgacctttacctttcctgcactttagccacaaactcccataccacagcctggatgtcatccactccacctctgaaatccagtactctgctctctgaccacaacctatccttgctactctcatgtgctcacttcctctaaacctattttattttgtttttagatttgaagggtgattattttattaacagtaataatgaaaaaatagtagtaagaatagcaacaataatactagctaccttttattgagcacttactatgtgttggatgccatggaaagcactttacaggtattatcttaatctaaacaacacgacatcctacgggacaggattaactgttaccatccttgttttagaaatgagtactccgaggctcagagagttttaagtttctcaagatcctatagcccagtaagcaataaagccaaaaatctgactctaaaacctgagctcttaactatgctgaactccctctatgaacttaaaacatatatgttattcagaacagattataatttcattttgaaaaataaagtgcaaagtcaagacagttgcatagaggaccccctgtagcaagtgtatggttacctttctacatattttctgaaatacttgtctttagatactaatcctaaaccatttcaacatctggttgaaattacacatgttgcttcatctataagactgtaaaacgtcattagcaccaagcaagcatatgctt

SEQ ID NO: 17279 - DNA, 1310 bp, Homo sapiens
acacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaatggtggcgtgctcatttccgggcagcagccttgtagcaacactgggtctttggagaagggaagtggtgtttgcacag

SEQ ID NO: 17280 - DNA, 1207 bp, Homo sapiens
aaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgct

SEQ ID NO: 17281 - DNA, 1467 bp, Homo sapiens
ggtgacagggtgaggccctatctccaaaaaaaaatttacccaagcatataaaatagtaattaccaaatggttgcttttctttggagatggagagaggaagtaggcaagttgtcatttaccgtgccctcacatttttggtcttaaatgacttcacttgagcatatattcatacataactatgactcttaaaaatcccatataaaagcttagtagcattgttgtaatggtaacatattttattgtacttcaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaagctaagtgtgtttattaactttactaaatagctatgagttttgagaaattaaatttttgacatctgacatcactcaccttctagtgaagcctaagggagctttaactcatggcagaaggtgaagtagaagcaggcatctcacccaaaactgtaaacaaaagtaagagctggttctaaataaaacaaataaaagtctattaatttaaacata

SEQ ID NO: 17282 - DNA, 2624 bp, Homo sapiens
attacctgagtgataaggacattctgattatactattgtaaaatgcccgcttgccttatatttttaagtggttgtttttcaaaagtgtttaaataaggcagtcatatttcaaagtatagagcaaaagtttttttattattatttttgagacagggtctccctctgtcacccaggctagagttcagtggtgcaatctcggctcactgcaacctccacctcctgggctcaagcaatcctccacctcagcctcccgagcagctgggactaccagtgtgcaccaccatgcccagctaatttttgtatagttagtagagacaaggtttcaccttattgcccaggctggtctcaaactccagacctcaaacaatccgcccgcctcggcctcccaaagtgctaggattataggcgtgagccaccacacccggcccaaagttttataattaaacagtattaacagtcttaaatactattaaatatatgttccaggaaatgtctacttttaacccgcaactactgaaaataagagtcagcatgtagcagcattaatgacccctgaatttgaaatgatttctgtttatttatacctaattgtagttgctgcctagcctaataaatctgtagttttcaaaagttaaaagaaactagttcccaaagttttgagtctcaatccatctacttccctgaataataaaacctgaattttgtaatacccacttaaaaattttattctcagctgggcgtggtggctcacacctataatcccagcactttgggaggccgaggtgggcggaccatgaggtcaggagatcaagaccatcctggctaacatggtgaaaccccatctctactaaaaatacaaaaaatgtagccgggcatggtggcacgtgcctgtagtcccagctactcgggaggctgaggcaggagaattgcttgaacctgggaggtggaggttgcagtgagccgagatcaagccactgcactccggcctgggagacagaatgagactccgtctctaaataaacaaacaaataaaaatgtattctctaaggacattttttttttggttactggttcctagagatgaaatgattatcttattttcagtaggcaaggtagtttaaatgcagaaattctgcgatatatgaatattgtgacatcaagaacagcttcattggcatattctttgggaaagaggcaagaagaataaaagggctaaaagtattttattttcagcttatgagtgttgttactgcttcaaattgtgtttagtcacctgagccataaatcagttgtagtagggctattgtattttaaatatattttttgttctccaaggagacttatctagtttgccacctccttgcctattgctctgatgtggttttccctccttttttatttattgcacaaatatctaacagttaaaaaagaaaaatttcagtaccatatcaattgtctttcatattttgtgttcctcctttccagtgcttttctatgtaagtaaatattctgatgtacttgtaagtaatcactcagagcataatgtaattttgtctttggtgtcttaaaattttgcagccaggcaagagaggttcacagggaaggtaggaacaagtgattattcagtgtgaggatgggaagaagatcaaagataagtaagggcaatgattgtatccttcccgtgtcattgcccctagtccccaagccaccctcctgcaatcatgagtatagtggtgtattgtggaaggcagcatgcccagttttccagtttcaaaatatattatttagcagtgaggcttaactcccagtaaatgaaggggtctgtgagtaggggaacccttcagactggttatattatgagctgtagaactgttgccattttgttgttcccagttgtgcccataaagagatgtgtctgagctggagacttaggctcagatggggaacaaacagccaagtaccaaccttagtttggtccaataggtgaattttagcaactctctaaactcagctctatacctgtaagactcagaagtgatacatatagtgatagaaaaaaatactttagaaaatagaaaacaacttactggttactctgctaatgtgatggaggttgcagaatggaaaatgaatgaatgcaaaaaaatacagctggattgtgtgccacaagtttattactcaataaatattctgtggtttgacgtgctgtattgtatttttaatgtatcctgatgagaaaaacaatcctaagacatcctgtaagtatcagacacgattgaataagaaggggaatgactccatgaaactatatttggcatcagtaagattcttctgccagttttctcgaaagcgaaccattcctggtctacaaaggaagaaaaacaaacacttttaaagtatttttaaatcaaaagcttttaaaatcaaacaaaggggattccctatttactcttttatattcctagtaagcaagaagcctcttttattggcgggggaggggaggtagctaaggttctctatgtctatcctttactgtttcttaagcccagtcaatgaaaggatttatgagcttatatgtaaagatactttaagagagctgctataaaagggattattatacatga

SEQ ID NO: 17283 - DNA, 1146 bp, Homo sapiens
tggtggcagacacgaaatttggttcatgataagacttcctttccccacctcctgatcagcattatttaaatctgtatttttctgttagttaagaaagaaatggcttcatgatattgtatttaatagcaaaagtttggctgtcttcttcattactgttaatagctactatattttaacaaggagatttctttttttgttgttgttgttctagagtttggaatatactgattatctcagacttgacatttatactgaaggatgaagtaagacctccagctttttttaaaaaaggtgttgatttggaacacctgtatgggttatggtttattaaggttatggtttagaaagtttttttccctcagagccttaacttgttaagaaggttcatttatcctgcactgaaaacaaaaactctatatactttgtttgtgtgcctcctgcactctcccattccctatgtgaatatgctctagttgatatttttaatatattgatttcttttttctcacagcaacaagtgcttactctagaggttagtgggccctgatatgtcatcagtcagatgcctgcctagccaaagctggactaagattattctgtacatttgttgatcttgatatagacttatatccctgtagggactgctaatggctccggcttctggagtaaggtactggagaccactcatccctgtgtctgcttgattggttcagctgttgaattgcccttttatttggaagcagtgttgaagttgtctagggttcaaatggctgctttgtacacctgtcattagtataaggcagatgtttattttatcaagctattttatctctacatttaactaaaaacaaaagttcccaaagatctgccttcacttcagaaattttttttggattaaaaaaattaagcctgaaccttaaataaagtgagttggttattcattccaaggattaagtcccaatctacctctcagcacaatgcagaagctcaccactgtattgctgccattaactcatgccagaaccctttgccaataactggaattacaaatttttgttaaagaaaatttatcaagatctttctttactgccttctctatatgtacatctcaaaaacatgtacatctcaaaaactggagtagaaagt

SEQ ID NO: 17284 - DNA, 3072 bp, Homo sapiens
gaagttgatcttgtaagaacatttctgacttttaaatcaacatctttgacttcgagacattcttttgtgattatactcattatttattacacactttttctcacctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcattatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaatttgcttaccttttttcccgttggttaaagtcaagattttgtatactacataatggcaatttctttcaaatggaaaaactttagaaatgtttagaagtagaactgaattatttgcaaaatgttctgatgttctgtctgtatattaccatctggaagaatagt

SEQ ID NO: 17285 - DNA, 2542 bp, Homo sapiens
gactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttgtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaaaaaaagtttctagagaagatctttaaaattcaagtattgtaagaaagttataaaatcacaggacttaaaatcttcctaacaacttctaatgaactcacatttgttgattttgttatttttaaactttttaaaaattttgtaatggttttgtggtaatgctataagagtatgggggagggcatggttaacagggtgaggaaaattcccaggaatcctcaaggtggataattattcttaaacatgcggatacaagtataaacattgcttcattcaaatcctcagtgtcaaattgtttcataaagtcaatatgaaatgagtctagatttgagttcaggggagaagaaaagattactcttagttatggcatttgctctgccttttctgttaatagttttttgagttctgggccagatactctcagagtaagatgttcctcaaagtttttgaacccagttcctgagtctgcttgaatg

SEQ ID NO: 17286 - DNA, 1123 bp, Homo sapiens
taatattgaagatagctaacattccctgggcatatattaatttatgaagaagttttttgttagccgaggggactaaagtttgctctggaatgtctatgattgtgattcattttgctgctgaccatcaagagttcactcatttaacattatgcaaaagtccatgtatacacgaaaatagaatagtatcatgaactcttccccctcccatgtacctatcatctgcctacagcaatgatcagaattcactgattcttcagtattgaaaccagttgataaataaccaaataagctttcaataccagtacagtgaaaactgttttatgtcttagaactaattttgtctgttgatttgagcaaagaagaaatccacaaaaagaaataatacaacaaaacttagttatggaggaaaataggaatttagcttcaattctcagtaaaggcaaaatgagtttcctgtgttctttaatctaataatgttattcaaaattaaatgtgtggattttattttttgacaattgctgcttcaaagccctggagccctaattagcatgggaacatgtggtaagaagttaagcaaacctcttcagaagtggtattgtcaattaatttaggttatatgtgttttttattttagggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaagtaagttaactactacacctactatacagagctgattgctatcctagttttttttccccccacatcagacaggtaatgtgctgatgtcataacaaggtttgaaggaagcacatctcatatatgagcataaaaacccaatcatcatgcttctcaactacaaaaggatcctagcttgatgtttaaaaaccaaattcataatgctgtttacatagacatagaggacatttagtaaatatttgctaaataaatgatctccttcattttgttccccctccagatttatcaagattcttttgaacaacgatttttggaagaaactaaccggc

SEQ ID NO: 17287 - DNA, 1136 bp, Homo sapiens
ttgactagctatgatgaccttgggcaagcttactaaatgagttccagcctcagtttcctcggttgtaaaatagattcctcagggtattgttgggaagattaagaggcttataaagtaccttgcacatagacagtactttaaatctcaggttaaaaattcatgtcgacttaggttttacacatgatgaaataagatcaggattgttattttttatggtcattcttgaatttttatttttttgaagcaatacaatcaataggagaaaaacctcaccttcaattttaataggtgagtcaaaatgacttaaacagtattatggcatttcaaattttattctttatattaagcttaaatacagtggttactttaatgattaggtgtaatagttataaagatcacaatttaccctaaaattagtaatgctattatattttatgaatctttggttactgtatctgacatggtattctgatgccaaccttttacatatcatctagataagcctaaattaccagaaaactacacagatgaaacctggcaaaaactgaaagaagcagtggaagctattcagaatagtacttcaattaagtacaatttagaagaactctaccaggtatgtattaatatgcataaccagatttgattaacataaattgaggtgggatgtatatggattttgctttctgaaataggttcttaagtagacttttggttcccttctaattttagtttctccattaattgatgaactctataattagaccacgtattctcacataaaccatgggtacagtcataccagtataagttgtgcttatatttgaccctcctgataagaaattacagttacgtgtaccttggtgtaatagaagttctacctataatgtaatcctatagcatgaatcccaaagatgatttctggtgacatgtcattctattgtgataattgtttcttagttgtgttacctacccataggaaaggcctcaagacatgcagatattattcatatcctttattctacctccttcttaatagtagactttgccatttctttttcttgctctttacatttttctaatacctgggctacaagacgcaccttagcccagaaatgagtagcagtttgtagtccagc

SEQ ID NO: 17288 - DNA, 1121 bp, Homo sapiens
aatatttagagaactagtaaagatatattatcaaaacataggcagtatatttaaaaattttagaacccatttgatgaccaaattagtggtattaattttgtttcagggttaatgtagcactttgatattcccctagtcttgtgacattgttactctggttctatagacccactagttagatcactaaaatcacttttagatatgagctgccacagagtaatgtagtttaatataaacaacaatgtaattgtgatgtcaataagttctttacttgtggcttaataattaaaaaataacaatatactttgaattatatttatcacgagtaagactataaaaatgcataaaagtatgtttatgtgttttttttccttctacagtgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttaaaattgggtagcaaacttggacattaaaaggtatctggtaagtaagcaaactcatacaactaatgtcctttcttaggctaatgatataagagtgaagagcaggacttggtcaatggattgccattttatggtagacctctagagaaactgtctagttaaatggggctagaaactagactaggaattttattctattactccaggggacccagcagtgctcattctcgtgtgtgtgtgtgtgtgtgtgtgtgtatgtgtgtgtgtgtgtgtgtgtgtgttttgttgattgtttttttaaaaaaaacttcaatggaaaattctaaacatattaagaagtctggagaatagtataatggacctctccatatccatcacccagtttcagtttatggtcagtcttatttcatctatacctcaattatttctccccaccccccaattattttgaagcaaatcccagacatcctatcatttcatccataactactt

SEQ ID NO: 17289 - DNA, 1240 bp, Homo sapiens
atgaagcttcttacatgagcattttaggaatgacaccagggtttagagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggtcgactgtgacatactgatcccagctgccactgagaagcagttgaccaaatccaacgcacccagagtcaaagccaagatcattgctgaaggtgccaatgggccaacaactccagaagctgataagatcttcctggagagaaacattttggttattccagatctctacttgaatgctggaggagtgacagtatcttactttgagtggctgaagaatctaaatcatgtcagctatggccgtttgaccttcaaatatgaaagggattctaactaccacttgctcctgtctgttcaagagagtttagaaagaaaatttggaaagcatggtggaactattcccattgtacccacggcagagttccaagacagtatatcgggtgcatctgagaaagacattgtgcactctgccttggcatacacaatggagcgttctgccaggcaaattatgcacacagccatgaagtataacctgggattggacctgagaacagctgcctatgtcaatgccattgaaaaagtcttcaaagtgtacagtgaagctggtgtgaccttcacatagatggatcatggctgacttcctcactaacctcttcacgtgtaacttctgcagacctaccacaagtttacatgtaaccacagaaatccctttctctcctgactcattactaatggataccattctcaacaagtcaatccaaatcagcccgttaaggagaaagaaattaatatacaagctgagtgtgaaagtagaaatcacctacaccagagagctattttggtattttgcctttaaataaaaagcctcctccatatggctgtgcagccttgctctgtggcttttcccagcacaatcagtgctagtgctggggaagggacagtcaagagcagtcagttgcttacttattttgctctggatgagtctgggacacgctgtaactttaacacatttaagaagaaggtgtgtggccttttcag

SEQ ID NO: 17290 - DNA, 1282 bp, Homo sapiens
ggtgcagctgtccaagcagccatcctgtctggagacaagtctgaaaatgttcaagatttgctgctcttggatgtcactcctctttcccttggtattgaaactgctggtagagtcataactgacctcatcaaacataatactaccattcctaccaagcagacacagaccttcactacctattctgacaaccagcctggtgtgcttattcagctttatgaaggtgagcataccatgaccaaggacgacaacctgcttgacaagtttgaactcacaggcatacctcctgcaccccgaggtgttcctcagattgaagtcacttttgacactaattccaatggcatcctcaatgtttctgctgtggacaagagtacaagaaaaaagaacaagattactatcactaatgacaagggccatttgagcaaggaagacattgaatatatggtccaggaagctgagaagtacaaagctgaagatcagaagcagagggaaagtgtcatccaagaactcacttgattcctgtgaattcaacatgaaagcaactctcaaagatgagaaacttccaggcaagattaacgatgaggacaaacacaagattctgcacaagtataatgaaattatcaactggctcgataagaatcagactgccgagaaggaagaatttgaacatcagcagaaagagctgaagaaagtctgaaaccccatcattaccaagctgtaccagagtgcaggaggcatgccaggaggaatgcctgggggattccctggtggtggagctcctccctctggtggtgcttcctcagggcccaccattgaagaggttgattaagccaacccaagtatagatgtagcattgttccacacatttaaaacattgaaggacctaaatttgtagcaaattctgtggcagtttttaaaagttcagctgctatagtaagttactgggcattcctaatgcttgaatatggaacatatgcacaggggaaggatataacattgcactttataaacactattgtacatggaaaaatgcaatgtcttaaataaaactatttaaaattggcaaaaaaagaaatgaaatggtaaactttaaactttacaactgactccacagaaatacaaaggatcattcaagactattatgaaaacctctatgcacataaaccagaaaatctagaagaaatgaataaactcctggaaatatacaatccgccaagctttgatcaagaagaaatagaaattctgaacagatcaatagcaagcagtaaaatttaatcagtaatta

SEQ ID NO: 17291 - DNA, 1282 bp, Homo sapiens; identical to SEQ ID NO: 17290

SEQ ID NO: 17292 - DNA, 1191 bp, Homo sapiens
aaacgccccctaaagatgtccacatcctgccatcacacaagtctttccttagtaacctgggcgatagctgtggatgtttccaaggattgtcttcagtcatggccttgggattaaagtgctcccgcatggtccaccctgcctttcgcaattatcttgcagcctctatcagacccgtttcagaagttacactgaagaaagtgtatgaaagacaacatggccataggcaatacgtggcctattcagctgtaccagtccaccattttgctaccaagaaagccaaagccaaagggaaaggaaagtcccaaaccagagtgaatattagtgctgcctttgttgaggatataatcaacttggaagaggtgaatgaagaaatgaagtctgtgatagaagcacgcaaggataatttcaataagactctcaatatagggacctcaccaggatcccttgacaagattgctgtggtaaccgctgatggaaaacttgctttaaaccagattaggcagatctccgtgaagttgccacagctgattttggtgaatatggccagcttcccagagttcacagttgcagctatcaaggctataagagaaagtggaatgaatctgaacccagaagtggaagggacactaattcgggtacccattccccaagtaatcagagagcacagagaaatgctggtgaaactggccaaacagaacaccaacaaggccacatactctttacggaaggtttgtaccaacgcaatgaacaagctgaagaaatccaaggatacagtctcggagggcaccattaggctaacagagaaacagatcagccaaatggccgatgacacagtggcagaactgtacaggcatctggcagtgaagaccaaagaactccttggatgaaagtccactacagaccagcaatacttcagagcccagtttctgctggatcccatgggtggcacattgggacctctctccctcccccatccacacagaagactgtcaccatgctgacagaaggctgtctttgtgaggcccagccttccagtggaacactcagacttgttcattctcttcctccttctgctctgggccttctgatgtgggtggctctcagaaaatacttgctgctggcaaagggcctttactcaggcatttgctttgacttgatgtcaccaagagactgaggacattggcaggctta

SEQ ID NO: 17293 - DNA, 1752 bp, Homo sapiens
caaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaat

SEQ ID NO: 17294 - DNA, 1157 bp, Homo sapiens
gtttggcactgcttcatcactatgcaactttcttcttgatgacagctagctctttctgaagttcagtaaacttgggggcagttttcaagtttgtaatcctaacacctcagcattattttattaaaatactctgtggacactgccaagagactgacatccagtatcttctttccacttgctcttgtggttgctgatttgtcattccaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgactttttttttttttgcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatct

SEQ ID NO: 17295 - DNA, 1149 bp, Homo sapiens
ttttcatttagatgatttaaatttatccctttgtgttattcagtagttcacctttcccaaattggatccatattgcaatgctttatttaatttggagtttagcctttaatggggaaatttgtaatgtttttaatggaactgctatatattttcttgggtaaactaataaattcaacggaaaacatcactgttgtggtattacattactttagggactctgtcagacagaagatgtgaaactttgagctgcgacttgattttaaaaggggtacagaattcaggtacttcattctgtcaaattataagaaaataactgaaatttacttagaaggcaaatggtcacgaataagttagacttcttatttatagttttatcaattgagaatagtgtttcctttttatatgaacaagtagttggtattagctattttatgaaattttaatgtaccatttttagcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaagtatgtaattcattctagtaaaattaacactatcttctggattttgaattatgaaatttaacttctaaatagtcatttatggaagaataatttcttagttttcattttgctgaaacctcattttctggatcatttgctacagtggttttatttttaatctgaatggctcctttttaagagaagctgtcatattttttttcttgtataaatttcaaaatgttttctaagtaaaatcacaagttgtattgactttaattgtcctctgtgtattagtggccctcaaatcctaaagagattctcagagatgatgaattctggtttcctgtggcacgacataacatgaagtagaacttaattccaagtctataaactgtaatgcctgtgtctgtttttttttttaataaatttattattatttttgagacagggtctcactctttcacccgggctggagtgcagtggcatgattacagctcattgcagccttctacctcctgggctcaagtaattctccagccttagcctcctgagtagct

SEQ ID NO: 17296 - DNA, 1679 bp, Homo sapiens
tagttttattctgcctgcttaaatattactttcctcaaaaagagaaaacaaaaatgctagattttactttatgacttgaatgatgtggtaatgtcgaactctagtatttagaattagaatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtaaactttattataaaaccaataaatagcttcccaagtatgccagggctcataaaaagtaaatagatgcccttagccccctgaactggtaaatatttaggtataacttggcatgattatatatatatctgtattattccgtgaactcttatgttgaacctgtaatgtaactactgaatttatgtgaaaaagactaccatattatgagtcatgcttctcttcatgtaattgtttttaggaagtagataacttgcaaaagatggtagacatccccaatagcaaaatgggtctaatagtaatattaaccatcatttattgagcacttactataagtgctcaatacatatacttcatgcattttctctaagcttcacaatagctttgtttgtttgtttttgagacagagtttcgctcttgttatccaggctggagtgcaatggcgtgatttaggctcaccacaacctccacctcccgggttcaagcgattctcctgcctcagcctcctgagtagctgggattacaggcatg

SEQ ID NO: 17297 - DNA, 3939 bp, Homo sapiens
tgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagct

SEQ ID NO: 17298 - DNA, 1161 bp, Homo sapiens
tggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcatactaccttgtatttgtttcactttcttagaaaaaataaaatcaccctcttaaaaatactgcaatgtaacctcctaaatatatcttatgccattgtacgtaggcgtaaggtacacattaggtcatgccatgttttaaaagaaaagacatcagttttcacattaatgtatggaattctataagtgcatgaaatgtcaatttttaaaatgtatatatatatgaacaatggtaacaccactccctccaaaaagatatgcctggttgtctcaggagatagtatactcactataacagaacttgaacaggcaaatagcaatgaacctaaaaaaccactgcccctttgaggcaggcagcaaggaaggatatttgtgagtttgcggaagcaactgccagtgagtttcagaagctgtgagcaatctggtgggataaagaatgagggaataaagaacctt

SEQ ID NO: 17299 - DNA, 1195 bp, Homo sapiens
gtggatcacctgaggtcaggagtttgagaccagcctggccaacatggtgaaacctcatctctactaaaaatacataaattagccgggcgtggtggtgcatgcctgtagtcctagctacatgggaggctgaggcaggtgaatcatttgaacctgggaggcagaggttgcagtgagccgagatagcaccacttcccaacagcctgggcgagagcgagactccatctccgccacccccccaaatatatataatttattataaatatatatattttatataaaaataataaaaaatttttttcatattaatgttttaatgataattgttaatgtgtaatgatgctacctaacacgtctttcttacagcaagcaaactaaggcagtttcttctctgtcctttcatctatttgacgtcaaaaaatagattgctgtttgagagtttgtagatgatgtcaataaagtttccattcttttgagttaaggctagtatgataattgtctaagaccacattgctctttttaaattttagttacatgagcatgcagcataccttgtggatagcatgtgggactgtgctactgagctgctgaaagactgggaatgtatgaatagcttgttactggaagagccacttagtggagaggaaggtaaggatgtttaattatgatatttttgtttagacagttttgtaagtagatttttactcattccatttatttgtccttttagttttaagacaatttgatagaaaaatcttacttcgtgcatagttttgttttcatataaatattatgctatgtaaaaagatgtaattgctgtcaacattctttatttttttgtatctgggttattttttttacccaaatgtatggatctgtggtggatagatttgggatgctgagggttttaggaaggtgatgttttctgtgataaagtaatgggattttctttagtaccttagggcagattctgtttacaggcagaagaaactgttatgtaataattacaagtggcatatagggagaagaaataagctaactctttctgactttttttttttttttttttttttttagcactaacagataggcaagagagtgctctgattgaaataatgctttgtaccattagacaagcggctgaatgtcatcctcccgtgggaagagggacaggaaaaagggtatgccaatcaatgtc

SEQ ID NO: 17300 - DNA, 1122 bp, Homo sapiens
acatattattgtgcataaatattatttcttttggttcaagtcctataattagaattgctttgtcaaagaagattaaaattcttaagcttttgctatttcatgttaagagttcttgatgtaaagattcaccacttaaacgtaaataacagagcatggttgcctaataatttgctggggttttttttcccctttatatttttatatgctatgttaatatccaattaataccagcaggatagcattctgccaaaactaacctgaagggtttctaatgttaataaaaacctccagtttaaatatacgaagtactgcacttttggtcatttgcatcatgttttagtgttttgcaataaaatacagtgcctcatttattgaacacctgtattttaaatgaaaatgtaatattttaaaagatgttaatctccaggtattaagaactttaacatgctttctttctttccaaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaagtaatctccagatattttattcagctctcatattttttagtcatgaaactttatttttaaatctagccctttcatttggaataactaaattaaatttatgctttattattagcttataaatctctaccctatctcctttcttaattttaaagaaccagttacagtgctatctcaattaacaaatgagttgggccaggcttggtgctcatgcctgtaatcccagcactttgggaggctgaggcaggaggatcacttgaggccagtagtttgagaacagcctggccaacatggtgaaacccgtctctactaaaaatagaaaaattagctgggagtgggggtgtgcacctctagtcccagcaactcaggtatgagaatggctcgaaccttggaggcagagggtgcagtgagctgagattgcgccactgcactccagcctgggggacagagcgaggctctgtctcaacaacaacaacaataaaatgagttaggattaaaactccgtttat

SEQ ID NO: 17301 - DNA, 2676 bp, Homo sapiens
atgtgaggtaagtagcatcttgattagtcctgatgttatttcattatatatcatggtcaatttaattttagaattatacatctgaagagaggggaagttttcaaagtggttttattagcatgttatttaacataataaagtattaatgtaatatttatggatatatttaaagaaatgaatgacttttaacgagattttctcccctctctctctctcattaggttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaaccaaatccctaattggattattactttaaaataggaacctgtaaccattattgctttaattttcatctggtatgagttaaacacatttacaaatgtttacattgtttatacagggtacatttgagtgcctactgtgtgctagcatgtgttaagagatctctccttcatagatccattggggaaaacaaaataatgaaacttgtaataaatgccaggaaggaaacaagcaggatatgctgaggtagagaatgagagagagacagtaagagagaaacctgccttaaataaggggctcatggcatggaggtaaaaccatttgaaaaagaatttactaattgaattcttattgaaaactcatcaaagaaagtgtta

SEQ ID NO: 17302 - DNA, 1357 bp, Homo sapiens
tgctaaagtgcttttttgaagtttattctctttcaaaataagttatcatagaatcttgtgcttgtatcaaactcctaattggtcggaacactttaggagtgcaggggttctgcttcattgcattttcagaattaacctgaaagttgaaacaaccatttttttttatttcaaaacttatttaagttgttatcacctgtccttaaatagataaaagaatgtgtattttttcacttgttgccttagtactatcaagacttgtgaatatatttgaatgtatgttgtttgaaaaacttgcacagggcattggagccatcatgaaaagcaggaaatgtaaacgtggaatgtatggcaggctgggcagaatgtatactgatccagggtatagactagatatttttgctgttgctgtttttattataaaatgttatatttgaggatatttaacattttccaattctgcttaagaggtaattcacaataaaaaaaacaaagaccaaaaatagcacattctgaaaaaaagattcttaataagattttattttgtgaagttcaaagattctttcctaaagtataacgtgttgttaaaaagtagtggtgttataactctcaatgtaatagtatgcaatatcaagaacacaggaagttcgtttcaagataggtgagatttaaaataaataggatgaggttgaagaaaagtatattggagcgcagataaatataaattgtggactgctatgaaaacaggttgtacttctccatatgtgagactactggaagtgagaagcaatatttgtcatttctaaaactggccaggctgtgctgacccaggattagtaatttgttatgtctgttttcccttagatgtttgggcactcagatgctatcttggtgcacacacacaacattgctgttcagtcacaaatccgaacaacttaatataataaattgtactaaaagtcatttaagaaataccaaaaagtaagcttttgtttctaaccattgttataaaggctaatataattgttgttatatagcagtaagatatatttgtgtgcatgcgtctccaagtcagttgtaaatgtcttgagaacagagaatacaattgtcatctttatattgcctcatttctccactaatacttagcaaataaaaggcaataagtaaatatgtactggttgaatgcctctggagacctagagtttaaagttttaagtcaataaataaataaatatttactcttaaataatatagaatcctgttgtgttttccccccttttttggtaaactttgccctgatttatttccaggtcaggctattgtgcttatccattcataaacttacccatatgtgatacta

SEQ ID NO: 17303 - DNA, 1145 bp, Homo sapiens
catatttcatcgaatctaagatgccttccattgtaagacacagcattattttatgtaccactgagggaaaatgctgccaggtgtaatttgtcatcagttgtaagttgcatcctgatttcagagatgctaaaatgtgaaagaaatgtgtatcatagaagatatgaaatatggtatgttaaaacctatcataagttttttaaaaaatatatactcataaacaaaattttgcccagaaaacattaagtagttctttaagataagagtacatttataataccatgtgtaagtagatacttgatgactatttttgatgggtattttatgtcttttcataaaaagaaacatctttgaaggttattttacattgggttatatagtttgttgggctatatagaacattaactgtgaatataacatttaagtgaatattcatgttaaaatttttttttaatgcatttacatcctagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtga

SEQ ID NO: 17304 - DNA, 2619 bp, Homo sapiens
cctacacagaaaaatacttttagacttatattgccaagccaaagttaccatattttggtgtttttgtgttttctctttataaggcaaaaagatctgtatttacactccttcacctagggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaagtgtgattttggtgaggaagcactcagaagggagggcttatgtgtcactgggttccattcgacttgactgcagtccccatcagctgtgcctgcactgtcatcacctgtcttacagggaaataccatttataagaattcttagtatattcaccctcagagatgagaagaaaccatgcgttttcagaggctaataaaggtgtcctgtactttcagaggccagccaagtacccttattttaaccctaaggattcaggcaacaaaacaactcaattagaggaaaggatgttgattcttaatgcatgtaaatgtcacactaggtcagatctgtgatccctccggccccagaaacaaaccctaagatacacatctggggagaacccagctacccctgctcagtagtctcagtagtttagacgcgcttccccaaagagcttgttttcacataatcctattttgcagcttttgaaaaccagttttgaacttttatga

SEQ ID NO: 17305 - DNA, 1223 bp, Homo sapiens
gaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgacagttcgcccttactcttggaggtcatgttcaggaggggcattcctttcccctgggggtcatgggtgtccccatgcccacatattgcacgtgcagggaggtaagtgcctgcatcccaaatcggttctaggtcaactggcctcaaactgatttgccatgagctcacaaaatgaatccctatgcttaatgaccaggtcacataaaatccagcccacttacaggttttctggcatctgtttgggtgtcctaatttttttggcagtgtcatttgaagaatttttttaaagcagtttatttaagaacatactgattaaatgcaggatcgctactaaaaattgttttgtatccttggtgggtgtcttctgctattttatctacttttgaacactttcaggactttttagccagtttgcctttcttgaaaaatg

SEQ ID NO: 17306 - DNA, 1914 bp, Homo sapiens
gggtccacactggtggcacctgcagacacacactggggcattcctccccagctcatcagagaccccagagcttctagaactttccagtcagaccagcctgcccaaccccaggtagtgaataactggaggaatctgagattgggcctctgagctcggccactacaaggcctggaactataagtgatcccttctattcttttgcctcagtctcctcttttgtaagctgaggataagaatgcctgcccagcttactcccattcccgggcctgaaatctacccaccccaccgcccatgaacatcaccatgacatgaaacagccagccaggggaactgcctctgaaaagccccagagaattcctgaagcctgatgatggtgggggacctgtggccatctggactatggtgacagctggagtaccacaacaggggactgggcgtcaccaagacttcacctcttggcagcttggcttagagaggctgtcaccccttctatccttcgcagctccagtacctgaatcgctactaccagaccatccgggagaaggtgggtccagagctgcagaggcgccagctactagaggagttcgagtggcttcaacagcacacagagcccctggccgccagggccccagacaccgcctcctgggcctctgtgttagtggtctccacccttgccatccttggctggagtgtctagaggctccagactctcctgttaaccctccatctagatggggggctcccttgcttagctcccctcaccctgcactgaacataccccaagagcccctgctggcccattgcctagaaacctttgcattcatcctccttctccaagacctatggagaaggtcccaggccccaggaacacagggcttcttggccccagatggcacctccctgcaccccggggttgtataccacaccctgggcccctaatcccaggccccgagataggaaagccagctagtctcttctcttctgtgatctcagtaggcctaacctataacctagcacagactgctacagctgctcccctcccgccaaacaaaaccccaagagagcaatgcccctaccacccaagggtgccatggtcccgggagagcccaaacctatcaccacctgttgggcatagccagagctgttcccacccagccagggcatgaaacatcaaccccccacatgtgaacccatcattcctaaaccctgggtaggctccatgccaagtaacagcagagggagttaagccataggaatttggctgtggagtaagagggaatgcggtgaggcactctggaatatgaccctaccagaggttggagaacaaacttgggcagccggaacccgtcactattctagacttccctggcattcgaggagccctttgaactttccaaagtgcagccacagctacaatgctgttaaatcctcccacattcttggatgccccttcaccttgtgtggacagtgtctggtttctccattttacagacaggaaaactgagcttcagacagggggtgggctttgcctaaggacacacaaatttggttgggagttgatggggccagatgagccagcattccagctctttcacccttcagcaacatgcagagtccctgagcccacctcccagccctctcctcattctctgaacccactgtggtgagaagaatttgctccggccaaattggccgttagccacctgggtccacatcctgctaagacgtttaaaacagcctaacaaagacacttgcctctgggttttgcattgtgtctgctgtgttgccggagactgctgtcacctgtggcttttgtggtgggggaggaagaagagagggtgaggtgggggtggggacatgaggctcctagaagctcagtgggggagcacgtgggcttgagagtatgtgtgtgag

SEQ ID NO: 17307 - DNA, 1233 bp, Homo sapiens
acctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctct

SEQ ID NO: 17308 - DNA, 1134 bp, Homo sapiens
gctgccatattgctcactgataagatctaagaatgacctttccccacccttgctaacatggggtatttttattgtttgtaatgttttttaatatgataggtaaaaatggtatctttgtgctttaatttttatttctctgattattagtgaaattggatgttttcatttaatgtatttttagctatttttttaaatgaatgtttttctttgtaatcagaaaaaaaagcctcgaagaaacactttttcttatgtatacaacagaactgcatgcacttagtggagttttatgggcatattctgtgatgttgagtgtctagtctataaaagacagggggcttggggaacctttgaatgcccccattggttttggagaggtggtgagacttttgggctcaagtgatggctagctgtgatattaactgtctttattgatttacagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtgggtgagtaaaactacagggacattgcctagggaaaaggctgagttgaactagaaagtcagggtggtcaccaattttgggaggagggaagatagatttagatgagaaatgaactagatttagatagggaaatttagataggcaacaagctcctgaaaaactgcaaatcagctgtacttgtgtagatcaaatcaaaatttaaatatcctctagcctaaactttacaaaaacctctttagtaaatgagaaaaataaactttacctatttttgaaatttagattttcctgtactggattttcatgtgggacccaccttacatagtgggaggagacacctagtccactggagggcagcattgaggaaggaaggtctgtctaagacgcaacccaagaagaggaaagttgctagcatttattgagtttctactacatattgggcactgtgctaagtgatttacctttctctcatttaagacttgtaacagccccatgagattggtattatccccattttacggatgaggaaataggtgaagcac

SEQ ID NO: 17309 - DNA, 1187 bp, Homo sapiens
ctctgcctccctggttcaagtgattctcctgcctcagcctcctgagtagctggactacaggcacatgccaccatgcccagctaattttttgtatttttagtagagatggggtttcaccgtgttagccaggatggtctcgatctcctgacctcatgatctgcccgcctcggcctcccaaagtgctgggattacaggtgtgagccaccgcacctggccacatgctacttttaattaccaaactccgttgcctgctatgattagtgtactgtctaggagattcaatgtacagaatcttcttttccccgtttgtcctttttataatgtcttatgtggtacctagcacttggtgggtgctcaacaaatgcttaccgaccagacaacgtacaaacctcattttctgacagttttcattcttttttcccccagattctggcagccaggaggtgctgtctgaattgagagtactatctcagaaattgaaggaaaaccatcagtccaggaagcaaaaagcaagttcagaggggactattccccaggtccagagagaggaacctgccccagaagaagaggagcccctgttgctacagagaccagagagagtacagacgctggaagagctagaagagctgggaaaagaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggtgagcagagccagggtggtgggccattgttcagaaagtgtcgttcttgcgcaaggagtaatgaagctttgttttgctgggggcacatttcagtagtttagaggtccagaatagtatagggccaggctagtcccagtgacgttttaatagatgcagatatatgggtgctgccaagacccctatttccgaaagcctgatccacaaaaactcctctggggtgactctaaaactgctctcagaggtaagagggagtaactcagagttctgaccagatcccaggcaggacaacttgaaggtgagtcattgaactgttgcgaaagttttattcagtgggatctcagatggtctaagactccccag

SEQ ID NO: 17310 - DNA, 1233 bp, Homo sapiens
ttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctag

SEQ ID NO: 17311 - DNA, 2041 bp, Homo sapiens
ggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatggaaaaaaaaaagattaaaaaaaaaaggaaaaaaaaaaagccagtttgaggatgggacaatctgttctctagaggctcctgagccatgcgggagcattggtggttattttctttgtattgtgtttgttctttgttcctgggggggaagttctcggcccccttctgtaggactgctccccacccccaccatactgcccagttggttttgaacagttgttttccctttttaagaaaaaaaaatacatatatatatacatatatatatataaagttgaggggttttggactttaatttgttggttttgttggggttcctggtattgtgtagtttatttcatgttctgtttgcctttccttttttcgcatttgggtgtatattctggctgccc

SEQ ID NO: 17312 - DNA, 1110 bp, Homo sapiens
agcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacaccta

SEQ ID NO: 17313 - DNA, 1192 bp, Homo sapiens
ggacacatgcacacaccctgcacacacatatacctacagtgcgcttgcacacccacaaccaacgcaaatagcgcacctgggtaaatgacaatgcaaaaacatacagaggtcaccccagaaggtatgcacattttgctcattctcgtgtaaggcagagtacgtgacacctacccgcatccaccgtatacagataaacgttgcccagaaaacacacctcacagatgctgactgacccataccaccaatctatccatccatccatccatccatccatccatccatccatccagccatccatccagccatccacccacccacccatccacccattcatcccttcattcattccacaaacacaaattgagtgtctgttacatgccatacatgatgcaaggtgctaaggtttcatcaatgtccaacacagttgttgctgccctcaaggaagcccctgtcttatgggggaggtaaggaaggtacataaaagtagcccaggcagacagcaccagcagtgaactcgcaaacatgaaatcctgatctggaaagaagagatgagcaagcccgaagggaagggctacagcgagtgaccttgggggaagggacacacacaggagtttcatgtttagacaaagtgggattaggtgaaagtgatcacctttaatttgattagtatgagaatgtttcctgggggcaggcagaaggcctgtgggagggcgggagctgctgtggaatgcaagccttggggcgcttaggctgggggggcaggggggacagaccttccaagcataaatggccttgggaggcttcacagaccagtggagaatgggtcgcaggcagggtctggtgggggtggggtggtggtgggaggagtgaacctggggcaagggctgcagtttcccaggcgcctcctcccagtactcagcctctcactcgtccaaagggaaattcagacctgagaggttgagttgagcgacttctcccgactttttgttggggtgggtggaaaggtgtgggggtgagggtgagggtgggggtggggcaaaggcacggccagccctgtgggctaacggaaaggaagtaggagaggcctgggtgtctcctgtgggggagagcggtcatcagggaggtcaccgtggtccccctccctttcctcccctttgcccctctctgaagttcctcatttctttccgggcca

SEQ ID NO: 17314 - DNA, 1254 bp, Homo sapiens
gaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaaggtaggtgcctgtcataactcttagaggaagatgggaagtacggcttagaaacattcctgtaacttcatcgggtgccctgagatgcattgtcccccggccaggtcaaattgtgcctgagcagaacaaaggtatagccttggctcaggaacattctttttcacttgggacttggctgggtgacctgggagttggcaggctgcttgtttggggttagtagagaactgttcccacaactccctcccagtgtgatatggggactgccccaggtagccccattgtgtgggcatggcctgaacgcaatggagtaagttagggacctattgttactctctctccctcagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaattctgttctcttgtcaagggggcaggtgggtgaaggtggaaagccacgcatattagaaagcaagcaaattgcagcaccgaccaagcacaggatttttctcagccatgtattcatgccctactccagacgcaaaactcctttcatttccgaacttccctcacccctccagacctctttgcacacacctgctgtggcctcggcccacaacacttgactcccctcctctcctctcaggaagttcactatctctgaagactttcccagccttccaagcctcatccttgtgtatgtgtctccctgctagcccatgacttcctggaagcagaagccctgatgttaaggccttgctcatggttttatctccagagcttagcacagggtctgcttcatagtaagtgcttcatagatcattgtcgaatgagtgaacaaataaatgtatggaatagactttgtttacctggaacaactcctgtcccagaactgg

SEQ ID NO: 17315 - DNA, 1199 bp, Homo sapiens
actgcacctggcctggaatagatgttttaaaatgagatctcaggccaggcgtggtgactcatgcctgtaatcccagcactttggaaggctgaggcaggcacattgcttgagcccaggagttcaaaaccagcctgcgcaacatggcaacaccccatctctaccaaaaaaaaaaaaaaaatttagccaggcatggtggtgcattcctgtagtcccagctacttgggaggctgaggcgggaggatcatctgagcctggaggtccaggctgtggtgagccatgatcgcaccactgcactccagcccaggcaatagagtgagaccctgtctaaaagaaaaaaaaaaaatttaaatgggttatcagctgtttttgttagtttaagtacaactctggcctgtagatggaaaacatgaattagttaccattacaagtgttctttgagcccccaaagtttatattttgtctttaacttgctttttttttttttatcatgtgttcatgttatgtatttgtttccacaggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggtaatagtggtgtgccttggagacccaactgattacaactcagtatctctaggaccataacacagagttatggtttggttttattatgagccagttagcttcatacagaagggaaaaaagtccatcttatgtccacacattctaccctcaggtagccatctggcagaagtgtcctgtttagtttttcaccaaactgatccttttgtaaaacattaaaagagaaaaaaattattttaagtgttctgtctggcgtatgttagactaggtgaatgaatggagatggcaccagcacttccggcaaaataggtcagaggccgaggtgggcggatcacgaggccaggagtttgagaccagcctgaccaacatggtgaaaccccgtctctactaaaaatacaaaaattagctggacgtggtggtgcatgcctgtaatcccagctactcggtaggctgaggcaggagaattgcttggacccaggaggtggaggttgcagtgagccgagatcacaccactgcactccggcctgggtgacagagcgag

SEQ ID NO: 17316 - DNA, 1145 bp, Homo sapiens
gccattcttctgcctcagcctccagagtagctgggactacaggcacccgccaccacgcccggctaatttttttttttttttttttgtatttttagtagagacaaggtttcaccatgttaaccaggatggtctcgatctcctgacctcgtgatccgcccacctcggcctcccaaagcgctgggattacaggcgtgagccaccgcgcccggcgataacctgaattttttcatccacactggcctttcaaactttgagtagttgttttgcttaagtctcacaacttttaccagcattctaaagtctgaccaaaagttctcatcaattaaatatgcatttgcaaagttaagttgatttattagacattggaaagtggttggtgttgttagaactactgaaaaatacagactcaaatggttttttccactgcatgtctttgtttgaaggcagtctactgtagaatatattcggacttcctgacatatccatccatctctttgcatacacttgttctttgtcctttggccgtgcaccaaagtatgacatcatctgcctttaaaaatgggtgagggtagtgttaaattttcaaaaagaagttctgatactctcattttaggaattaactctgttttgtggcttgattcctaactgcttttaatctgatttctttttcatgtagtagcatctaccgtgtgtttttgcacaggtgggaaagagcaaggttcgtttatacaccatttctccctccaccttacctttaaacttttttttttttttttttttgaggcggagtctcgctcagtttcccagagtgcagtggcacgatcttggctcactgcaacctctgcctgctgggttcaagcaattctcctgcgtcagcctcccaagtagctgggactacaggcatgcaccaccacgccgggctaattttttgtatttttagtagagacggggtttcaccatgctggccaggctggtctcaaactcctgaccttgtgatccacctgcttcagcctcccaaacctttaaactttaaacctgccttgcaactatctcgttgacatctgtcaccattgtcaggttcatttccattatatgttgcattctgccttaaaaccatgatagctactatttgtttatttacttta

SEQ ID NO: 17317 - DNA, 1149 bp, Homo sapiens
tgcaaaagaatcaggaaggcttcggtatcaagtaactggtgtcctaaaaccaaaaaacaaagtgcgatgccggggctacgctgttgtgagatgctgttatcagttctcgtcaccaacacagcggcagcaccaggcacaaccgccaatcaaagcggccccacgagtccctccttgaacaggttccttaactcgttcagtccaacactgtgccacaaactcgcgaaaaccggctacctagagccagcgtctttgcgagcttgcggccagctagtgcatgcgcaaatcctctcgccgtgcggaccaatcgcaatgcggcagcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggtgactgacccattccaggcaacctccaagtccgagggcctggcgccttaggctccctgtgccttgcagccctctacccccgcgtccccgcgagaaacttaacacatagtcacgtgaattccaaattggcagactccgaaccctgagtcttgcaagcggaggaattggctcagccatgccgacctgaccttcaagagatttgaacccagtagtcggcttgaggccttttcccgggagcgtttgctgttcagggatcccagaacaactggctgtcggcgcctccccggcatccccaccccccacccccctttttagagcaatgaggtcaagtagactttgtcatttaccgattgagactttaaacaggacgtttaagccctacgcctaagtttcttgtgtaaatgagggtgttatctgctcagccttccaaaccacagatgagatccatggatttgaatgcccagtgaaacagaaacggtgcagggcaagtaaggagtcggttgg

SEQ ID NO: 17318 - DNA, 1187 bp, Homo sapiens
atgactgaagcaatcaacggtgaatattggtggaactttacgaacggacattgctaatgggcaccgtggtgctgaatgaatacaacatgagctttggcaacacccagatgtaggtttgaatgtgtgactttagaaatgtgacctaaattcactgagcctcagattttaaacctatgaaaaattccaaacattttaaagttaaaaaagaataagatagcaagcataaatgcactcactatgaagtttcaaggtatattgcaagatgtattacaaatacagccgtagcctcatgtgtatccttctccaagcacattgctctctctgcccctaccctgccactctccccagtcccaccacatatactcaaacaattaatgatgaaaactcaaaaagacccagacacatagaaactaaattacttctgaaatggcaagggttggtagagactctccttgcaaggttaattaatatatctgacaaagaaacagcaaaagggcttgtttagggaagtcatggatggtatttctacttttaaaatataaattagaattttctaggaaaatattagatttctagtaggctacatagttttctgaacaagaccaggttagttcatcactgtaatgagggctcagtacagattggctgtatgtgggtgtgatggttaattttacatatcagcttggctgagtcatggtgctcagatatttggttaaatatcattctgaatatttctgtgaaggtgttttttgttttttgtttgtttttttgagaaggaatcttgctctgtagtgcccaggctggagtgcagtggtgcaatcttggctcactgtaacctctgcctcctgggttcaagtgattctcccacctcagtctcccgagtagctgggattacaggtgcccaccaccacggccggctaattttttgaatttttagtagagacagggtttcaccatactggccaggctggtctcgaactccggacctcaaccgcctcggcctccccaggtgctgggattataggcatgagccaccacgcccagccctgtgaaggtgtttttgggtgacactaagatttaaatcagtagactttgagtaaagcagattatcctcctttatgtgggtgcgcctcatccaattagttgaaggccttaaaggaacaaagactgatcatccctgaacaaca

SEQ ID NO: 17319 - DNA, 1166 bp, Homo sapiens
tggctggagcatcaactcggatattgggataccatttgcagttgagcaggttcacatcacttctcaatccatttcctcttcggaaaaatgacaatgataatatctgtccttatctcttttgcttggaggttgtaagaataaatgaaacatggatggaaacagtttgagcataaatacataaatccgaggaattatgactcttcaggaattatttatgtataccagtatttgtgtatttagaaagcccctcccttacccataaacacatgcacacttcaccatcatcatcaaacttaaagagacatgcacacataaatcctcatgttttcaaacatactttttttcctcattggcttttaaaaaatggttactttgaactgtgtagaattggatggacattaatatacttttatctggctatgtatctatttatttattcattaatatagtcaacagatatttattaagttctactatatgccagatactgtaatatgctgggggaaaaatataataatcaagacaggaatgactcttggctcatgagcttatggccaaataaggaagacaacagactctttaaaaagtttaagtactgtaatgggggattgtcagagcatagtagagtacctagcagaaccttagatgtagagggtagaaaaggtagaaatgcttcccacagaagtaatgttcatgctgaggcttttagagaatgagtaattgcaacctagcaaagagaagtggggaagagcattccagtcagagggggcagaatcactgcaaagttgtgcagtaatttggtgtgtatatctatctacacttagatatcaacccatttacaggtagctgtgcctctgcctaaacttggagaaactgcatggcttttcagaccttgtgaattgttggctttgtccctgaatacactgaatggatgaaaccctggcctagcatgaactgcttttgctcgttgattacttttctaactcataaaagtcaagttctcaatcttgaatgttttttagaaccttcttatggttctgagtgttgtttattttggttatcccgactgcagataattgtgtatttgcactgaccatgaatttagatgcttttaacaagtttctgcattttggctgggttagttactctatttagtagagttgtgt

SEQ ID NO: 17320 - DNA, 1143 bp, Homo sapiens
gaaaaattggagggtgtgaaaaatggagaaatttcttataacattttatttgactaccaagtaatcacatttgaagattttcctgtttgcccctgcagtttcaaaatgttaaaatcccataagaacccagaaacacacagcataattattttaaagaacagcttgcagaaattctgcaggaagcaacaatgtatatatgagatcagagttttatgaagacacggtacctggtcccagaagctttctttttcaaatcatctttgacaatcgagattaaaaaaaaaaaagacaaatagatttctttaaattggatcctgctttgttatattcccagctatcctcctttctcaacatggttgaaaaatgtttatcaggggaaaaaaaagaggaacaaagtaagcaggaagtaaaggttaaagagcagttaagaaaaacaagaatttgtaaatgcccaagaccagaaaccggagcccagtgccctggggatttcagtcaaattgctgtcaacaggatctgaaagagatggagttccattgtaaggagagtgccattcattagggctaatcccaactaaaggggatgtgcctgagtacctgagaggaggcagagtcagttgaaagagaatataaaggttatgtctaggagtagtatagaaacttcaaaagcaacaagaagacatgggctgaaaggttgggctctatagtggaagttagagaatggaggaacaagaagggattgttttatcacttaaactagtactaagtaatgtggttattacaaaattgcctgtaacttagcaacccccatttaaaatgtaagctccatgagatgagggcttattgtctgtttgtttactgatactaatatatatatctccagcaccaagagcaatttctggccatagtaggtgctcagtgaacatttgttgaattagtgaatgatagaagtttactatgaggtttcctcctataaaataaagttaatttgtttccctgaactgcctctaattgctgctttggagtgatgaggagtaaaaggtaaagaaggaccttaaacccaagatgtaaatcaaagtaacagtggaaacctggctcagggcaagaatggtttgagggctgcctttagaaagtgttccattcatct

SEQ ID NO: 17321 - DNA, 1154 bp, Homo sapiens
aacccttggcattccatcctctgcttctgtgagtttgactactttagagatgactttaaacaaatgcatacacctttgtagttaacaccataatgaaaacataaactattttcatctcaccagaaagtttctctatatgactgtttccagtcaatctccagtctgcataggcaaccactcttttgacttctatcactataaattagttgtctgttactaagtttcaaatacatgggatcatacactctatgctttctggtctctgacttttttcccttagcatttttattttttagattaacccatgttgttgagcgttatcagtagtatgttcatttttatttttgagtaatgtgccattatatgaattaactacagttggcttatccatttaccagttaatacacatttgtgctttttccaatttttctctgtattatgaataagtctgctatgaacatataagcccttattgctatatattccactctacgcactgctttgccccatctcacaaatttagatatagcctgttgtcatgttaattcagctgagtacttttacatatcctgtggggtttcttctttgacccaaatattatttatattttttagatacttctttgttattgacttattatttaattccattgtgccaaagaagatgttctatatgatttaaatagtttcaaatttactgtgacttgttttatggacttgaatagagtctatcatgaagaatgttccagggactgtaaccttagttccttttggaaataagagttccttagtttgttccaaaagatatataagaatatatatagacgttgaaattatatattcaacgttggaaccactaagttccaaaagaacttagttccttttggaccagtagagcctaaggtcatagtgacagaaagcacaaaatttgcttgtgaatcactaggagtaatagtgaatcaagccactcccatttttacctctaatacttattacagaatccatgaatcctggctgttggagaaataacaccatatgttggacattattttagagcatcctgaaagacattacctctggaagacattgtcacctacctggtactgtagctcaatcttcaaaaagccattccaccattgtagtaaacccgcttct

SEQ ID NO: 17322 - DNA, 1111 bp, Homo sapiens
gtctgtcaagcttgagagctatctggactcttatgttagagccccactaaatagcgacctccctctcaacatacaaggcctactgactaggtctgaacatggagtaaacctcccagggaacctgggtagggagtcaggagaagaaacacgtggcctggtgcccagatttgctgtcctccaagacctcagatgtcaacatgttttttttcctttctctttagacatggatccctgaggtcggtccccaatacgacaagacaatttgatatcataatagaacactgcagaaacaatgctgagtgaagaagagtagaaatgggaagacttggttgagcggaaactgagttcttgaaaagaggagatgcttgatgagggtgagtggattacacctcagtttaatatccagcagaagccaaaagtggaataccattacgcaaatgtagcaaaatgttaggtagccatagtttctggtgtctttgtctcttcttggccttttttttgaaacgtgatgggcgggagaagagctcctggagcaaagttagttggcttttctcgtacaatactgccatcgtgcggaaatagtttcatagcgtccaaagccgtgagcgtttcctgcatgtaagccctagcagttgcggaaggaaaagccacccaagacacaagttggcattcctacccttttctctgaggcctagcataagcaatagacaaatgcaaagtcttagtgaagtatctgctgagtgagggaccaggactaagccaactgtttccaggaactcctggtacaggaaatagaggacagggcctcagtttcctcatagtggggacaagactagaagatgacagagccaagtgcagacccctggggcatttatgttatgaatatgcccttgggagttttaggcaatctggctgtccctgtgttatgcagctgtgacatttatagcagcatcgttagattgcaatggacaggacagttccagggacaatctatctgaagccagtgtcattcacatggtcctcgatacacaaaaattctaaacaccattgcctacaactagagggacctctatagaggagtgaggatacactgacatgcctatgtgggcca

SEQ ID NO: 17323 - DNA, 1646 bp, Homo sapiens
gcttttgtaaattatcaagcttcaaaaagcttttttttttaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcctcaatgtttgttttccttgagttgggggtgtggtatgggacttcaaggactcctttgtcctttattgttcaaacactaaaatcgaaatttctgttggaaaccagaagatacttttcacatttcattaagcattaattatagctacaatgaacatctgtcctgatttctaggcctcctgtcttgaccaaattattaataaagtcccctttcacttgaaagtgtcctgggtt

SEQ ID NO: 17324 - DNA, 1171 bp, Homo sapiens
tctttactgaaagtggaaacagagtccaacatattactgatgctacacttgccattgtgaacagagagacagttccatttgacgtcttgcagatcaagggtgaaaaggaacagcctgtgtttgcaatgactggcctttggtggggatccctcagagatgctggcatcaaagttagcaggtactgatatcttgggtctctaaaaatcaaagcagcccactttttcagcactcttaaggagtggcctcagactcatgaaacttctatcttgtatacaggacctacagagagacctgccaatgaaccagaggagacccctgtacgaaggccttctttgtacaggagaatattacggaggcttgcatcttactgggcacaaccacaggatgccctttcccaagaggtgagccgagaggtctggaaagatgtgcagttgtccaccattgaactgtccatcacaacacggaacaatcagcttgaccgaacatgcaaagattttatgaacatctgcattgaagccgacaccgtcagcaaaggaggctttataactataggaagcctaaaggtgagaaaagccaagctggacactgagggcatggagtgtctccaagccagccagtacactttgcttgtccccaagggagcagggagctcttttagcattgacagtgaggagtatgaagcgatgcctgtggaagtgaaactgctccccaggaagctgcagttcttctgtgatcctaggaagaaagaacagatgctggcaagctccacccagtgagcaggcagacgacaagtactccgagaccacattttaggccaccggtgggaccaaaagggaacaggtgcctcaaccatcccaacagtgttctcagaggctctcaagggcattttcatggcaactacccctctgccagcctccagcagtgcttcccaaagtgttctctgtcacctgctttgcaatcagcttctgttagggcatgttttgttttggtgtgacggtcgaccctcctaaacacgggctttcctcaggctggttcaagatgggaaaggactttcttctgttttctcccaaagtgcaaccacagtggaaagcccacagtgggcttagcctgcctaagcccttccattcccattctattctttgattgtactaggaattccaggaaaagtgcc

SEQ ID NO: 17325 - DNA, 2968 bp, Homo sapiens
ataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctctctctcaaaattacagtgttcattgtcattgacctcagcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactgaggttggtttctttaattatttggtgtattgcttcatgttctggatttgctaacttataaatctttctcaaaactgaaaatcattactttttatcaaaatgatcatgtgtattgcagtacatgtttaaacaaagttaaacattcattcgcctgtttccttagttaccattctggcatattttgggggaaaactgagaatgatatagaaattatatattatatattatagaaattatagacaatggctgaaaatgaatgatatgtataacctgatctacatgcagaaagtggccaaatgacaaatttgttcactgggaattgtccatgtataaaatatttcagacaatatatttttttggaggcaatcttgctctgtcactcaggctggagtgcagtggcacaatca

SEQ ID NO: 17326 - DNA, 1096 bp, Homo sapiens
gggatattttggcactgttaacagacagaactggaacaagacccaccacactctcctgactcttccttcaataacctttcaatatttctcactctttctttctttctttttttttccatttcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattga

SEQ ID NO: 17327 - DNA, 1195 bp, Homo sapiens
cctttcagtacaaccacttttccatgtaattggctcaacactgctatttgcataattgtcatatttttctgcttcccaagagggctgtaaagcgtaaaggtgaactgcaaagctttgacaaagtgcacatttatgtgtgatgtgcaattctcaaattacgaagaaaattatatctttttcattgagtttatcttacacttggaaatgaagtattcagaactcattgccccctgagatgagtttagcctgcttttctttaacttggccaaagtgcaatttcctgagccttgggtcttcaaataatgatgttgccacaggaccttgactgtatgaatgacctaaagcagaggcatttttctttaagccgcggaataacaataagctcttttagttggaatcagagatttcatcacagctgggccatccgttaagctctgagaggtcaaacagatcatttaacctctcaaagcctcagtttgtttaactgtaaaatgggcatgcctttaactcacacatgtattgagtgcttatatgtgaggaagtattttacccagggcttggtgcatagtaagtgttctaataaacacatgatattgcctcgttcctcttcttttatagcaggtggatggcatttaaatgaatgagagggcttgaactttggcacgggaaaagaatggagttgagtcctgcctatgtcacctttttagggagtgggaggatggggttgcagagagctgtgtgaccttgggcaggttacatagcaggagagcctcagtttctgtatctgccaaatgaggatggataatagaatgtgattgtgcatataaacagcatgtaaatgctcagtgttacctgtagttattaacatttcatccttaacagcggtcattatcaggtttaagatatggccctatgaggagttaatgggtgcagcacaccagcgtggcacatatatacatatgtaactaacctgcacattgtgcacatgtaccctaaaacttaaagtataataatttaaaaaaaaaaaaaaagatctggccgtgaaaacttatgttccctccaggtttgctgtgtgttgtcccatcacttttcacattggggagagtggaatgttcaacttcccttcctgtgaatgctcctggaagcctcctgcttacttccccaagtggggactagatttttacaggtttcctaa

SEQ ID NO: 17328 - DNA, 1503 bp, Homo sapiens
gaatcctcttgggcatatatagatgaggctaaacgccaagtcaaatctccagattgatttgcttttaagaaattggcccacatttcctgtgtgtctgctagcaagctcttggcccttggtggtctgagcccaccttgccatgttagttttcttagaggggcactttcattgcctcagaggaactttgtttacctggacttcatctgcgaaaccttgaacaatcctctgcattcaacattacatgactaattccagattttttttttttttttacatctctgtaccttatagtgtggtggtcttgtttcttcaatgagtaagcaatatatgctttaaagtggacttgtagaatttgaaagtattacttgttacttatttgacacaacatcagaaactccatatgaagatgttctgcttctggggaaagatgcatggatcctagggtggtcatatttcattaaaatccaggggatttaataattttgccatcaagcatgtgccaccactattatcataaccttttcctgcctttgaggcagtgaatctgttgtactttgtgcctttgctgtgaacaaatgacttgtactaagaggttttctcacataacataggattgaattttcagtcacacctttaccaataggaatatgcccccttgtatatggggtatggcttcagtatagttgtattaatccaagagcttgttgatgctcttaagcctagggtcctttaaaataggtgagttggattttagtgatgtggggaagttattagtaggtaataccctgtaagaggaaaaccagattccaaagtttggagattgtattcagaacacagtttatctagaaggaggtcttatgagacctgaagattgctaaggtatataggagggaatatcatagattgaattgatcactcttagggaagaaggtgttacagacacaatgagtgattgttcaacttctgtagtacttcagcagctgaaggataaggctggagttgcatttagaggagagtgacagtttggtttctaaatttcagttttttggcctctagagtagtttatgttgagcccagttacatagatatcagaacaggattttggtaagaatgaaggaaagttgttttgttttgaaaggagtgtgaagatgctaataacttgatattttagtacagagtttacatcctggtcatgctgctcttcagcatgtagcacttccaaatgcagggcaaaatgaaatgtgaagaagatggtaggggtatccatgacagggaggatcatggctgcaatccattgttgccctgtgagaagaaattctgaatgcactatgaatgcttgtatagtatctacatggtatgttttcaaataaaagattaaaagttgttaagtgactcagtgactattatgtatataaatttgttctcttaatttatgggtcaagttttcaagtaatccatggaaataaaagtttgactttcagtgtgttcatttcctattgcttc

SEQ ID NO: 17329 - DNA, 2564 bp, Homo sapiens
actttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatattctggctggtgtgtataagtggttttttttttaaaacaaatcagaagacataaaattgaaaaggcactccatttatatataagggaaaatagattgtaaatagctaaggggccttgtgagaacttggaaaatgtgctgatacttagtaactacctcagttgtgaggaatttcctttttagcttagactgctattacttttacttggtagaaatgaatctggtctccaaaatatggctcagagagttatccccatagaccttgttagattgtttttaatttaaaaccttgaactctgcccagctgttttcttccagtcaaattctctaaaccaataacattttccaaattaagtattcttgaaggttcttctgaactcttactgatttgttttctttctttgcattttttcctgttactcttttattatttaaattgtctcttgcttttgaacttcaactatgaaataaacaaatcatagatttttccattcaggtctgactggataactcttggcttctaagcagctggcaagctcacccccactccccaaaaaagaagaaaggcaagttgaatattttaaaaccttaagagtttggagtatgaagtagaataaaagccttgttaggagaagacctgacttttccaaagttaacagcatgtgaagggcttgtgttttacaaagtcatttataaattatttttctttaaaacacatcacctactctgtaccttaaagattttacaactcttagatttatattttatttcaaaaatcgtaactagcacctgttattttgattaaaagacac

SEQ ID NO: 17330 - DNA, 1196 bp, Homo sapiens
cctctctcagacacctatgtaagtgactttgtgacacagctttcctttcattggcaaatgatctgagatgccacattccccaaaagaaattcaccctatatacaaacacgttttccaatttaattgtgttttttttccagttttcaaatttactggaaaagcagttatttaaacactgaaaactctcgtttttcctttttttttttttttttttggtgttggtttcagaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaagtactccttgtcttctctgttttgtttttgttttgttttctttcatgttaaaagaatgtttgggaaaggtagaaaaataaatcaccaaaattctgttggttcaatggcagccttttcttcctctcttacctcttctctcccacacactgtccttacacgtgtacattttagagttactaaacaatactgtgatcagaatcttcacctatcattattattgtggggtttttttgtagctattcttagaagggggaatatatgtttactcaggaatcttaatttttaaagtaggttaatactgccatacccattttagctcttattctacttcctttctgcacaaacaaacatacacacacaggctccacatttggttgttttgtgtgactgtcagcctactagtcatagtctaggaaagcatttaatctctgtgagcatatgtttccttgttagaaagtgtactcagagctctttggaagacaggtttctacgacaattagtgtggactacactgctgttgactcatgactctgcagaattaccaatacagaaagtgaaattgtagtatgtga

SEQ ID NO: 17331 - DNA, 1511 bp, Homo sapiens
gccttcaaaataaaccattttgggtgcttaaagtagaaatattcaagttaaaaaaaaaaacttaattagttgctcaagtcttcaaagattttttaccagaacatggagctataatttcattttcaaatgtacccagacttgtcctccttttcctccctgtgcttctcattagcactaactagttgtggcaccgaatccccagtagcccaagaatgtcttggggtttaattcacaagtgtgtcttggactacgtgtgtcacagggcttttggcaagaatgtcaaattacattttcaagtaacgctttttagaaatgcagacaggataagtggtgcattcggggctatatggcccaaagtgtgaactttgcactgaggggcagacgactttgccagcagaaacattagccaagtatctaccctgttgttgtcctttacataaggcaagcctttcaccattagacaaaatcttcccggaaagatctctctgagatgaaagtgcactatttttttctttttaaaattagatattgcaggccgggcatggtggctcgcgcctgtaatcccagcactttgggaggccgaggcgggtggatcacctgaggtcaggagttcgagaccagcctagccaacatggtgaaaccctgtctttactaaaagtacaaaaattagccaggcatggtggtgcacgcctgtaatcccagttacttgggaggctgaggcacgagaatcccttgaacccaggaggcggaggttgcattgagccgagatcacgacactgcactccagcctgggcagtagagtgagactctgtctcaaaaaaaaaaaaaaaaaaaaaatagtgccaaaacaaagacgtgccccagtgttccagtatcagcaagtctcgataaggttctgcttgagggtcactggtggagatgagatgggtggagtgcatgggccactctgggccttttatgtgtggcagtgtaaatggtgccatccactcggaccaggttactaggaaaacttttattgctgctacccgtttttgaagggtgtatccttagtataaattccctgtgggtgagtttaaacctgtcaacatctagcaccttcttcaacagagaaaattattatttcctgctgtctcttagtattttcttgctttgaggtgtatgtgtgtgtgtacgcatgtgtttgtgcatgtacccatgtacactgggggcagggaaaaatgatgggtacttttctgtgaacttagaaacctattttgataggatccagtaagtgaccctttattaggtgtgaaccctgttaacattaggtgagtatagtttattttccaaactgacaagttattttgccttgaaaattcatgcataccacaatggaatctttgcaggtgcttgaaaaaacagcctatcctatgatgaattttagcttatagcaatctttaaaaattttatttaaagtctttattatgaagtaattcatttaaatcaccctatgtgggttctcattctgagca

SEQ ID NO: 17332 - DNA, 1156 bp, Homo sapiens
agtggtccagacacatgctcgagctgtgcatagtgttatactgaggctatgggtagacttgcatttcaaatccttctcttttgattgacagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaataaaaatgtattggccctttttttgcaaaccgtcgtctatggtgactgcgcaatgctttttttttccttctcactaaactttctatccaacatattcttatcaggccccaacaggttccttgaaacccacctccctgccttccttctgggtggaaatcaatcctgactccaagaaccaataagaaagagccactccctcgcaatccacaatcttcatttcgaaaccttgggttggagtatcttgtctatgaaaccgaagtatctcaaaagagttacctggtctggtctctctttacaacttttactttgccaaaaatgctttgcccaaataggaatcctctatgtaaatcaggtacagttacaccattcatcttctcccttctcccaaatcaagacaggtgagcccaaacagtgcaaagaaatcactccccagcttctttgctgctgtctcaggcttgctgttgcctctctccacaggggctgccacatggcatgggcagccgttgctttgggtcaggttgc

SEQ ID NO: 17333 - DNA, 1153 bp, Homo sapiens
tacagtgttaatttacataaatgcacagtaaaataaagcaaaggtgaaaagagctgagatttgtaaatgtgcttaataaagacagaaacaattagcttcttctttatttatgcacatatctaaataaaaatgtctttctcctccctggctgtctgaggatagacagccatcatgaacgacacggtaactatccaaactacaaagttcatgaccaaccgactacttcaggggaaacaaatggtcattgatgtccttgaccccaggaaggcaacagtgcctaagacagaaatttagagtgcctaagacaggaaaaactagccaaaatgtacaagaccacaccagatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaatgcaagaacccaataaagaaagtcagggggaccgcaaaggccaatgttggtgctggcaaaaagtcgaagaagtaaagggctgcaatatgttatctgcggccattgtggatttttcatgagaggatttataaactaaaaactttcatgtgaaaaaaatgtctttcataattgtttgcatagcagtactacttcagagccaatgttaagctacgagggtgctagaaacagatatatccactttactccaagaagtacctgtgttctccaacaacagcctttcagaaattacaagtagatttcagtagagaggaagcaaaatctaggaaagaaacccagggcatgtaaatctgtttctctttctttttcttttctttttttattatactttaagtgtgcaggtttgttacatatgtatacatgtgccatattggtttgctgcacccattaacttgtcatttacattaggtatttctcctaatgctatccttcccccattcccccatcccacgccaggccccggtgtgtgatgttccctgccctgtgtccaagtgttctcattgttcaattcccacctatgagtgagaacatgcggtgtttggtgatataaacctatttctatatttccgttagtagccattagc

SEQ ID NO: 17334 - DNA, 1246 bp, Homo sapiens
taatcaccacagcaatagagaagtctcaaattcattttcacactggattttcatgctttaatttgtacacatttttgtgtctcttttttttttttttttacagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactgtgagtaccagtctacagttgtcagaggatttgggccttattggggtgaggtggccagtagcaggtactgatggagagaaatgagaacaaaattggaaggtggggaaggggtgatgatggactgaatgacctcacagagttaggcagcatattaagaccacaggctatgcaatcgtaaagcctggctccacctacttccttactgtgcgatgttgggaagtcattttatctttatgagttcatttttctgattcatgaaatagaaataaaaagaatatcgtcttcatagggaatgacatttgttaaagcacttagcacgtgtctggtatgtggtaagtcttcgataaatgttggctattattagcattattgtcagttatcataatcctcattattgatacacaatagatgacaagcctgtgaagtgggagctattatcttcatttta

SEQ ID NO: 17335 - DNA, 1159 bp, Homo sapiens
tagaatacttagtcacgtatgactttttaccactgatgcaaaatcaatttggcaatttataatcttacatttcattatgaaagtatattattctacaagaaagctgctggaaaaatgagatatttctgaagcccattcactcctctcctgcttaagtagtcataaaagaataaaaccaatcatgttatctgatgttttgagaattctaggtagttttttatttatatgatttttttaaaaagatatacgaagtatacagtttctaaccctggatacaattttgaatgttggataaaattgtggacattaaaaagtaaaaattttgattaaagagctcactttttcacctacgtttttcaattttgtagtgtgtggacagaaagaaaactttgcttaagtatgccagagggtgggcttttttagtgtcctatatttgaggttttgagctccagctctcctcaaagggatagagcagctggttattcatatttaataccatcacatttttcaattttggtgtttggaaattctgagttatagaatgatgaaccagcagtatttgagaggtggtggggaaacagaaaaaggaagagttggagacttttattgttattactgtaattttttaaaaaaatatcttccctttttctctctaggacaaatgtaacactgctttttgaaaaaccaatgacagtcataaaacacacatgacagatccttagttttaggtgctcattagtacagtaggggacagatctgttcttatactctcatatagcaaacaagaacataattaacattgactgtatagccctttacttctgctatgagctcagtgaggattttctttaactgcattaacactggaccatttaaacttgaggttttcatctttttcagtttaagtcatggttacagagttggcaggggtatctactatattaatttagattcagttgggatcaagtatgtctaatttacatatgatacaaggactgtgggccactcaggcatttgcctgcctccattgtttcaggtaattccactgtcattggtgtatctcctatttgtatattctttctcagactccagtctgaacacatggaacacattgaacaaaaagagaaacacagagcaggaattgactaattgaaatgag

SEQ ID NO: 17336 - DNA, 1153 bp, Homo sapiens
tgcagtagttatgccagagcgccctgtgtagagcggctgcgagcgggcagctgggctcggctgccgggagccaccgcgcgggctccgcaccctcctctcgcactgccttcgcccggtccccgcgccgcggtgccccagtggcccccgccgcgctccacgccgcgcccccgcaccccgccggctaccggccgcacaaccgccaccgccccctggccgcgcggctcgcctcgccccgccccgtccctcctcgccccgccccaccccagtcagccccgccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggtgaggaggggtcccttgagcgtgcctagcgcccagcggggagcaaggcgcgcgtggtggctgtaccctgagcgcgctagccccgccgggctgtagtcgtgcgccctgcagctgggcacttgggagtggtcggtgtgcctggggcctggctgggtctactgagggagggagagagggtgtgtgtggacggagcccacatcccccagtctcacgctgctgtcagggaaggtgtgagcgggaggaaccgtggggatcgccttctcgtgagcgcccgttttttggaagggcgagaaggtgggagctattttcccgggtctctgcgaactggcgccccacagccgagctggtgcctcatgaatttgccatccttgctcgcacatacgtgtcagaatttcagccttagctggaccacagctccagccatcccttccccaacgtacccccaccccccgccgcctttacccagcctgggtttcctaagctcacgggcccaagtgcaagcaaagttgagga

SEQ ID NO: 17337 - DNA, 3414 bp, Homo sapiens
tgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttcatatttgtttgtcttttttgtgaaagtgtatactgaagcttatttgataacagcaatagtattgtgttccttttagtcttgctttatttcagagtaaaatgccttaataacttttcattaaacaagtatgggaggaaaaaaagtgtgaatttgaattcagttcaaagtttcacaatataaaagttttatcatggagagaaactgcaatcttgtaagtacaatcgaactgcattacatcttggtttttttattacatggttcagatgcccatcgtttaaatcagatcctctgaaacctagttagaaggttattttg

SEQ ID NO: 17338 - DNA, 1428 bp, Homo sapiens
gggaggctgaggcaggagaatggcgtgaacccgggaggcagagcttgcagtgagcagagatcgtgccactgcactccagtctgggtgacagagcaagactccgtctcaaaaaaaaaaacaaaaacaagaaacaaattaaactaatgtgatagactactgctttgttttcaaaagatacactccccaaaagttactgatctaaaatacagtagtactatctctgtttagtaagaaccctgacaactaatagtgttcttatatgtaaaatgctattcttgcctttcatttcagaatatactttttaaatgtgaatttctggatttttttttatagcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaactgctttatgaattcaatttaaaaatccttaaaataagtcctgtctctttaaaaaaacctatgcatagttatcatttctctacaaattaacctagtttagttttctgttggttccattttccttgtttgttaagttttagtagctagtttaattgtaatctcaatgattatgtggtagaatgggttggcggagctacaaaaattcctagctacttcagagacattaaatttcagacacatggtacactttatattacattttactatgctaaaataacacggctttcttttggaattctgttcagtttttcagattgtaatctcagctacatctcaacagattgttctcagatatgtcctattaccttctttgtgtagatagtgctttattgactaagaacaatgacaacaacaccttttgttttctgggaataggagaaaagttttaagccaaaa

SEQ ID NO: 17339 - DNA, 1131 bp, Homo sapiens
ggtgacatgcgattttttaaaaagggacttggtggctggcgtctttcccgactgtaacgtgggttacggcaggcagaaaaacatctggtgataattctgaaaaaagtgctgtggcgtttgggggggttgtaaagcacgttttgcgggcgggatgggggcaaatctgacatttaaagtgtttaacaaatgagtgcggccgggaaattctcaggaaacggactgggaaaaaaaaaacaacaactaacatggaggggcggggagagaaaactgagtaaggggcagtgaccgactgtcagcctcgctagggtcgggagcgactggttttgacagaatgtaaatgaacttttcctcttatttgcaagaagttagttatgtcttggaaagaaatgtgtgattaatttcacattgtctctcccgaattaaaactttaaaggttgtttagttttccccgtagggacttgacattgtggaagtttggctagaatgcgccgagagaaggtacatcgtgtgtttggggtgtgggggacgaaggcatatgcaaaattaaaagacaaaacgttgtagagtatgaacagaggaagaggcgtattctttggctcttaaatcatttagccaaacacattgcagttcagaagggggtggggctatggcaactcgaaagtatcgattctttgtctattgtatcagtgaatgaccctctcctgaagtgacaagacgcccctttgtaatctcttttcgtaagtaaatttcagtctaaggggaaatatgtaaactaggggatcgaggtggctttttaggggtgtaactcgttgtactatcactgggagagatgaaaggggttagggtgaaaggtataaatgaatttgattccaagagcaatctggaagggaccttcgcctttgacaccgatgctgtttcgaatgaacttttgtttttctaagtagtcaactaaggaaatgttaaattaggcatgactttaacttctgacatgatggctcgtatatttgtgtggaacaaaatgttgggagaaagttgtggagttttacatgataattgtacatttgctaaacatgttttttttttctttttaagggcagtcaacgacatttttctccattaatcccaaagtca

SEQ ID NO: 17340 - DNA, 3469 bp, Homo sapiens
ttgatggttggggaacagtgagcccccaggctggatagggaaggaatccctgggctgggtatagaggttcttgatgtccagatctggagttttactggaaggataggaacaggagccagttgtcaggataaagaggcaatagacaacgggtattgagaccacaagtgtagattattcattgtagaagcttaactggagaataactgaagggatcaaagaaagggactcttctagaaatagacctttgggttttgaaagcaagaagaaaggaaatagtgtaaggaattataaatggcatagaattggagggggaaatcatttaaaaaatgtgtttgaattgaaggccctttgggaatggggaagtgataactctaggggagttgaaagactttgttttagagtagaggaactatgaggcagtgtacttgatcgaacacctctgatagtccgagtatggttacctcaataagtaaccattcctcttgctccaagcctgatgggaaggtaaacataagaatagaaatttcttgagctgaagtgaagtgaaggaactccctcccgaaaaccatggcatgtcacgaggaacgtttattgtaggttaggcggtctggtgcctctaggggggacaatcaaatgatacaggacctcgaagagtcttactttggatttctgtggctttataatgtagtatattatgtagttcattgctgtggctttatgcttttttattatttacaagtgatttactgatttgtgagctcttgaaactgtgtcattgcatgttatgtttaccctgatagttgcatttgcttataattctttttgctttgtcttcagttcagatattttggatggcagtagtagcagcagtggcttatcctcagacccgctggctaaaggcagcgctaccgcagagtctccagtagcatgctccaattcatgctcttcgttcatcttgatggatgatctctcacccaagtgacttaaccatttctgattcaacgttttaactgctgtttcctacataaaatgtttagtggggaacgcagagaactttgatccataatgaggattaaagttttacagatttcacacattctgatgctattattactctttggcatctctcttctccaaagttcaattttgtgagcctagtgaccttactagtatctggttttgctgatctcattttggatttagtgattaaatctcaaatgctgatttttgattgcttagaggaatcttttttcttagtgcctcaaaaaacacctattttgagtctatacatttaagaaaggcactgatgtgtattgcctttaatggtccttttccgcagcagtgatatgacagatttgatcagaaattctcttgcttgagagatttttttttgtcctctgttgactacatagtttcaaatctctctttatttcatgatgatatataaattgcttttaattatattaaatttttatttttctgcatcagcttcaagtacattattttgtttccctttcctgtttgagccgcttatgccatttctcacagaggggaagaaatacgtagttgctttcattactcttattgcttctttgctgttggggtgtgtgaagtgagcattgattttagtgctgagaatgtaaacggacttacaggatgcttggattagtcatcacaggttcttatgactttgctaccacagttgatatatttctcctcaaacctgttgccctaaggaatatataaaatattgttgatatttctaggtggtgttatcaaggagaagaaattcctgccttgaccagatgtgtggagcatctacaaatgaatgaatagttatttacacacaaaccactgtgtacaaaagcgtccatggagctgtcagtgtctcgagtggtattatgaggcctcaggtgccttggggtacattgtcatgctataagggatgtatatcataaggtatggtggaagaggggccttatgtgaatgattgccacatactgtttctgttgctgctttttttccgattcctttttgtcattggatttgtttgttttgtcatgtggtgaatggtgttttagttattgtgttgctgccagaatcagaatccagttcttgttcttactgccttatagttattgtgttgccaccagaatcagaatccagttcttgttcatactgccttgtagtgagggcagtttaatatctacaaagaagcttttagaagctgaaaaagtcaatgtgattgtgcattctgcttttaagaagctgtttcagctatgaactgtgtatgtgctataagtgtgaggtaccataagttatttaatttttaaaagaggaaactcctgagtgagctgtttaagaaatctgagtgtgatctattgttacgttatttataactaggtaaaatgtctgtcgtgatagatttcttttaacgttcagatactgtggttgggttgtctatatttaatatgcagatttgcctgctggaatcataatccatttttaagtgaatgtaagaaatgaaaactactgcatttgtgtcttttgaaggcaaggatccttggattttaaaggaagagtatgtgctttgaaggcactcagagactagtaatagcatatggtttgaagggaaacccattctctttcaattacaagagagcatcacttagcgtgcagtacttctgttacagcatccgatgtgtcctttattttaaattgtaaccataacagccattaatggctttatttcttgtattgctctcatctgggaaaagtctctacttcttcaaacgtaacataaatctattatgaagcttgtcccctagtatgccattataaagaaaaaattcttcgatggtatgcagtgtatctattctgtttgtaaaagatcatgtcaaaatgttctgcctctataatgataatagatggttttgtctttcaggatatttatccacctactgtcttctttgccttaaagggacacttggccatcatttttaggctcgaacttaacactgttaagaaataactgaaatatgatggtatttacattaatttttgaaattcaatggtgggatagaattaggtcaggaaatggaagttgttccaatggtgtgagaactaggagacaagatgattcactttattatttaaaccaagcttcatttttagtttttgttgtttaaatggactggaaagttaagtttttgcagggattgttttgaaataaagagatatgctaactcacagatgaactttgttaagacccctttatttttatataaagtctaatatttgaaaagcgattgttataaagtaaaattctctcttcctattctaatatatatcatatatttcaggcttctatttgaaaacaggtataagagatgatatgatacaaccctatagataatgttttttgcttgattgacttatataatcactgtttcatgattactgcttttgg

SEQ ID NO: 17341 - DNA, 1288 bp, Homo sapiens
tttatgtatgtaaaactacaaacatactactttgaaatctgattccgctatttcatgtttgtcttaccatgttattatgtattttcctacatccaaagctacctagtatctcttttgtatgaaggtttcatcatgtatcccccagtgccctttggttgtttttctttgttgtcatttattttggtgggggttggtttgctttttgttgttgtttttccttgtttttataaatgatacagtgacagatgccgttgtggataaatgctgtggcatagtcatcaattccttgatatatattcctagaaagtgcaccaaagggtatgcatggcttagggcttttgatactctccagagttgggataccaagtcacactactcactggagtcaggatgagagttttttgagacaatggtggcaattctgattcaatagattaaaaaatttattactacctttcattgcctcaagcagggtgcatttcccttccttcaagatcaatataatatttaacgcatcacttctctaaaatgtttccttaaaaaaaaaaaagcctatagcacctggtattcctggcagtctcccctccaagtactaaccaggcccaaccctgcttagcttccaagatcagatgagattgggcacattcatggtgatatggctatagatgcatgtttccttcttgatcatctctactttaaggctagagctaactctgtttcctaggagagagaacttgatcctttccttctactccactttacctatccctgagtctcacaacgggtttgtcaatctcactatttgataggttaaaatagtttattttgatatgttattttgtattcctttgaatacataatcaggattaaatattttcataggcctattgcttagttgtacttctgtttttaactatagggagtaattttttaaaaaaaggaaatgagatatgccttttatcattcagtgatgggcagcaacttcaggtgaggatgtcagtttgaactaacctgaaagaacaccaccctaatccattgcttccccaccttcttttccaaacacaccataacaatggacaacatatttaaaaaatatttttaaaatagtagccattctcaaaagtataacaggaaacctctaagacccagaagcagaaggaatgcagagcagtaaatgggacctgaagcttcacagcccttggaggctagcaagggaaacaggtctgagaagccaggaaagagagctaaactgtaggcaggtactgacggagctagaactaggtgttct

SEQ ID NO: 17342 - DNA, 1699 bp, Homo sapiens
tgggtttttattgttgtttagttttggtttgttacgccagcccagtctgtctgcggaacactgactctgctctctaatgagaacaaagttagaaatctgccgataacctaaaataatttagaaatgaattaaaaatgtgaaatcgggttaaagtgatgatgataaaatagcatgcaagaaacaagctccttccatcagacttggctactgttttcttctggtacgatttggtttggaagagcctcttgtttccttctctttggggtatgtcttcgtttcttaatatgtttgtaacattattgagatataattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccagtgcccaccccatccccgagcccctggcaaccactaatctatttctctctctgtagatttgcttattctggtcatttcatataaatggaattctacaatattcggtcttttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgtttttggtagtgttttttgggctttttttttttggacttttaatctcatttcttctgcttttctgtccccagaaaaatgtaagagctaattttatgactgtatttttctactgtgatgctgttttactgaattcaatggataatttaattgtacatgtaaa

SEQ ID NO: 17343 - DNA, 1595 bp, Homo sapiens
ttaagccaaggtatggactttagactttatcctgagggcagtgggctaccacttaagggttttaatgggggatcctcgaaaatactcctattggaaatgtctcttgaacttctcaaaaattcttaaatcttactttatttgcatttagaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtctt

SEQ ID NO: 17344 - DNA, 1197 bp, Homo sapiens
gtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaacttaacttatgggttggcaaatttttggtgcttatgtgtaagggtggatgtatttgcttatggtcacaattggactctttaggaaatatgactcaaagctgtcaaattctattacattgatttgtagcctgttagcttagtaatggataatgttataaaaatgctggtatggggaaagagaattctatatccagttaggtgggaaggcagttccaagtatatccagttaggtaggaaggcagttccaagtttggctaaaagcatgatcacacaaatacaaatagtcctccttccaagttaaagacacgtctctctgtgcatgagaagttttataggctagag

SEQ ID NO: 17345 - DNA, 2051 bp, Homo sapiens
gacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgcctcctgtcttttcattctgcctggtggaatcgctataaggtgatactcctaatccagaaacctaaat

SEQ ID NO: 17346 - DNA, 1169 bp, Homo sapiens
gtagcaaagagatgctattattggtgaatagcagcaagctaaaattattttctcctagtctcttttaaatgaggtagaatattaggaaattaaaataagaaggctgggcgcggtggctcatacctgtaatcccagcacttagggaggccgaggcgggtggatcacctgaggtcgggagttcgagaccaacctggccaacatggcgagacccccatttctactaaaaatacaaaaattagctgggtgtggctcatgtctgtaatcccagctactcagaaggctgaagcaggagaatcgcttgaacctgggaggtggaggctgcagtgagctgagatcgtgtcactgcactcctgcctgagtgacagagtgagactccatctcaaaacaaaaacaaaaatgaaaacaaaaaagaaaaaagaaaattaaaaaatgtcaaagtagatcatataattccatgaagttaaaagtaaagaaatggagaaagtacatgcagaatcgtttttccattggtttcaggatttataaccagcaaaaactcaactaacatttggtcatatgattttatattcctgttttaggaaaacaaaactgtcaagtgggcttctaggtgggattagattttggagtctgtgcctcatgctaatattcagtggtttaggtaagcacttcatgaagtaaaaagtaagtagttttgaggtagaaatgtaaatatatatatatttaaattaacatattttgttatcacagatgatcttgggttacatctttttccttctctgtgactgtagtttcctctctcctcttctcccttccactccccacatacacaatgaaaaaaagataaatgtgttttaaatatgttagtgtttatgctgaagggaaagagcaatccgaaatgtcatggagatactacgtctgcatggaatgaatattggggtggagagtcagtgagatatgactgtggaagttgacactgtgcaagagatgaaaaataaaatggaatggaaacttctgtttgtgggttcaaaaagttcaggcacagtagagagttaggaaaaatagtaaccagctggggtagaggaaggtaaggatgtcataaaaatctgggaagcggtgagaaaagggtgaaaggatttcgtgtgacaaacccacaacttgaagtggctgtg

SEQ ID NO: 17347 - DNA, 1099 bp, Homo sapiens
acacaccagattttgaacacttagaacaacgacaaagataacgtaaaatatttgctcaataattttatattaacacaagtataaatcataatatttggacatgttagaataaataaaatatgatgttaaaattaattccatctgtttctttttacttttttaaggggggctactaaaaaatttagaactacacatgtggcttgcattatacttccattgcacagcactggcctagcccctgcccacatgactgctttttgttattttctttatactattgttgttttctcaaagctgcctttgagaaaaatgctcctgtaaatattccatgccctcttcagattcaagattctgttttgtgataatatctgtatagatgtttttcagtttcatttcattctgattctcacttcatttatttccgagcagattagttgtccagttcagacaaaccagatcccctgtcagattcctccatagaacttctttacaaaaccacttcttggcatcataattggtggcattttccccttcggctgtatttttattcaactctttttcattctgaacagtatttggtgagtattacatcttcataatcttaaaagtgttagtttttagtaaattaacattcctatagtttaaggaggttaaattctgatatgataatacttcatttacctccctttatccagtaaataacaatctgacctagaagaatttcctagagaaccgagacttaattcatgactttaaaaatatttatttttaatttttgtgggtacacagtaggtgtatatatttatggggtacatgagatgttttgatacaggcatgcagtgcataataatcacatctatggagaacgaggtatccatcccctcaagcatttatcctttgtgtttcaaacaatacaattatactcttttagttattttaaaatgtacaattaaattattattgactgtagtcaccctgttgaattcacaatttttaaaaggcacgttttgatggaaatatttataaagatttacttttttggctgggcgcagtggttcacacctataattccagcactttgggaggctgaagcaggtgg

SEQ ID NO: 17348 - DNA, 1141 bp, Homo sapiens
tgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataa

SEQ ID NO: 17349 - DNA, 1134 bp, Homo sapiens
atctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaagaataatcttccaacatgtatttattgagcgtccattatgtgccagtaactgaagtagcaactggaagtaaacattgtataatgcagataaggtcactgtcctcagatagtctacagtct

SEQ ID NO: 17350 - DNA, 1433 bp, Homo sapiens
gaaaaacctattagtttctctctctttgtccaataattctctgagatgtgctactaaggaaaacatataaaagagcaacacaatgtattccatacacccttcttccctgccaaaacaagaagctggaatgacctgctcttttggcttcacttggtcaagttgtaaactgagcaataatgggtgctgcttcccttgtagagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggttagataaacttgttctgcctttttcgttccccatcacatactgcttcatgtctgtctgttcctgcaaagctgctgcagctaccacatttaccagtgaagaaaagagttaattcttcatgttgcagagcaggcagttatgcaagtggttttgcaatcaagtttgtaatataattttttaaaacaactttacagtctccaagcaaatatagatccctagcagactgcaggaagagaggctcagaagacctcctgattagaaatggagatgtcattcagcttctccatgggaatgctgagggtcaatggtaggtgtgtttgcaaagcctgtgatgatctccagctggggcacatagatagctaatcaaatgttctgctttatctgtatctttgttatacagtctccaaaagcagaaatatcacagcgatggctttcattttcattgcttcagcactgcctataaagctcactgaaaggaacattaacctttggtgagtgaaaaatg

SEQ ID NO: 17351 - DNA, 1131 bp, Homo sapiens
tgatgatgccatcgaatcattaggaaaaggatcttctagcttgccccagatcttagaaaaaaaaaaaggaaaaggatcagttatgtcgtgtgtctttgattaaagaattcaaggatgcatataatattttctagaaaggtttccatcaaaaatcactatggttaaaaagatgtttggttcttcaatgaataccctttagttatctagaaaattaactttttatgaatcaaccttattttccaagaatgccaaataaataaagagttaatacataaaataagttctaattagtatcttaaatctgttttcttaggcaacttaaatcactttttactagtacgtatcaaagttattttgaaaaaaatcatagttttatttttcaatttatcttcagagttaggacctagaataaacttaatttgagctggatcgccttgaagaaaaattatacctacagaggtgctaatttaacttttattttctgtatttcagattgaagtggtgcctgattgtcaggagaagagaagttctggtccatcctccagtttggacaatggcaatagcttggatgttttaaagaagtatcctttatttattaatataaactcacatacacatctaactgtgggagtctggttcagtgttcaaggccaatgtgattagaaatttgagttcacagaatggggttttactgggtgtcagaagtccaggatttaggcctggccaacctatagcctatttatgtgatttgaagaaaattaactaaactttttcagaatgttggtatcttcttttttttaccccagactgaaataaaatggaggttttcgtttatcattcttaaaaaaagttttattattatttttcattgacacataatcattgtacatatttatggaatacagtgtgaaattttgatacatgtgtacaatgtataatgatcaaatcatggtagttagcttatctattaattcttcagctttattgatatataattgacaaaattatgtatatttaaagtgtacaatgtgatgctttgatatgtgtatatattgtgaaatgattaccatatcaagttagttaacacatctatcacctcacgtagttaccattttttttttgtggtgagaa

SEQ ID NO: 17352 - DNA, 2219 bp, Homo sapiens
acaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatct

SEQ ID NO: 17353 - DNA, 1180 bp, Homo sapiens
tttcagagtggtagacagggaagggaagaatgtcaactgtctgagccaaagtcccagagaaagcattttggaaattttggagaatatagttaatcattataataatgatgattactattatgattcttacagtgtcatatacaaccatgggttcacagggcaatagccctgttagctggattagacaaaaataaagtttaatcctaatgtcgtggctgttgagatgggcctttatccattggcctctttgacatactgctaattgagctggtgtcaaagctctctagatgactgcaaaggaatgtggaaatttcattctgttttagctcattatctcctgtttaccccaccccactgccggttgctagctatatcaatttttttattgctttagttactctttccatgctttctcctgctttctgtactttcatttcctttataaagtagttttaacacctaatctattaactcctaatatttctgcttcatagaaatacttttatctccgatggttggatacaagtgtttgagcacaccaaaacgtgcttacagttgcagtcttgaatagataggtttgtgcattaaacacgggggtggggaacttggtatcatgctgatcttgtcgcagggtttttgcccataaaatagaagatagaaacaattaaaatctttttctcagaatctaaatattctctagctttatcaattggtaatttgcattctatcaatatgtctatcaactttcttcattccaccaactttcttcatttaaggtaaaaacaagaaaaaatgtagttgtcaaaacatgaataaattatttacctttgaaagtttaattgtttattagaatcttctggaaacaaatgttactttagctggtttctttttctaagcccattttaggtcactaagtagacaatatgggtaatctttattagcagagttgttcaagtcatccacattgttgaccactcatcttctgttttgcttgggcaatgccaaaactgagtctgtaaattaccttataatttcaggcacagaatcagaaggaaaaaaataaccttaggtttgccagttaaactttatccattttcacttttctgggtgttttaaggggaaaaaaaataataccttacccaggtaaaatttagcctatctttctaaagaggactctgta

SEQ ID NO: 17354 - DNA, 1111 bp, Homo sapiens
cttattttcctcatctgccatgtgcagctattagtaccttgcctccctcactggattgtgggggctaaaataaggcattatgtagggtggggttttgagaatgcaaaaacatgaaacaaaatgaggtgatttttcttctctgtcaatttggcttgtctcctgcattgacttttaaaaaactcactaagggcaagaacaaaaccttttccttaccttttgggaacttgacaatatgattcttttagccttgctgagcatttgccaaaaggacatctttgtgctttgggcagcttctttattaggccttagcagctgcttatttctttcatattattatgatttcattttgtagacgttctgtagagtgctttaccgccgccgcccccccaccccgccccatctttgaaaacagtggcgtttggttgtcttcagagctcttaaatagtagcaaaggccccaagcaggcttgagtggactcctttcacttgtgtgtatgaacacactagtggcagtaattaatgaggaggatgggctttgtaaactggggacaagtgagtgagtcatggcacacaggctgacccccctcacctgggcagcctctgaggacacctgcctcagatcattaaagccccctgcccaatagacatagtctgactgcctctgctggtaggggtgaacaaagctgagcatttactggctggagtgcagggatgaatggctcttcggccaggcctggcccagacagctgctcatgcaaagggattccaaatgaacatgtttctatttagaacgtacatgttttgattgaatttgaagaaaagcatgaggtagcgctctctttggaaaacaaactaattatgtactcctgtgttggctggtggttggaagccgggcatgtccacaacagcacttcatggaaagaattttcttccctgttgaacatgagactcttctttagcaccacagctgatgctttttgaaaatcacatggtggatagctgaaaacgagcctttagggaaagcttcagcacagtaaatattctttttatattggtaattaccaccacacaatttttttgttttcttaatttggattggtatattttgggtt

SEQ ID NO: 17355 - DNA, 1177 bp, Homo sapiens
ctccactttatgaagcccattcaatgaagagcctagcagccaataagatgaagatacaagtacctggcacagcttgccagagagcgagcccttgttcacttatacactggatgaaaaggtggacaagttggtgcagtttcttctcctcaaatatcaagcaaaagagcctctcacaagagcagagatgcagatgaatgtcatcaacacatacacgggctactttcctatgatcttcaggaaagcccgtgagttcatagagattctttttggcatttccctgacagaagtggaccccgaccatttctatgtctttgtaaacacattagacctcacctgtgaggggagtctgagtgatgagcagggcatgccccagaaccgcctcctgattcttattctgagtgtgatcttcataaagggcaactgtgcatctgaggaggtcatctgggaagtgctgaatgcaataggggtgtgtgctcagagggagcatttcgtctatcgggagcccagggagcttgtcactaaagtttgagtgcagggacattacctggagtagcgacatgtgcccagtagtgctcctccacgttatgaattcctgtggggtcctagagcccattcagaaactagcaagaggaaagtagtgagattttggtcatgtgaaacaataccgtctctagttcctttccaatctcttccaaggatgctttgaaagatgtggaagacagagcccaggccataattgacaccaaaaatgatgctactgccatggccagtgcaaggttccgtgtcatctccagaaacttctcctgtcctgagtgaagtatagggccgtttcttacgtctgtgtttgaagagggcagtcagggtcctaggtagtggagggcccgggtggggcttgagggaacaatacagtgttctttgcatttctgttccatatgggagagatagatttacctcgtttccttttgtgtactttttgaatgattttccttttaatagtaggttgaattagcttcagaatattattttataaatattagtcacacatatattgctgtttatctagtttaagagtaacagtttgatattttgtaaaaaaaaatggaaaaagcttgtctcttattttgtgatctataacaggataacatggtattgtactaggaattttctttaaattatg

SEQ ID NO: 17356 - DNA, 2468 bp, Homo sapiens
actataacttgttttagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaattagtctg

SEQ ID NO: 17357 - DNA, 1151 bp, Homo sapiens
tccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaa

SEQ ID NO: 17358 - DNA, 1614 bp, Homo sapiens
cttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaacc

SEQ ID NO: 17359 - DNA, 1041 bp, Homo sapiens
gtataagtgtacttaattccactgaactgtatactaaaaagtggttacgatggtaaatgtcatggtgtgtgtatttgatcgtaataaaatgcaaagataactctaatgcagacatccagaagggagtaatgtgtggggtgatcctgtgggagtcagaatatcctgttcctcaacagactcttttacctagtggttgtagccttaattgatgatccttgtctgagtcagttattaaatcggtggttccaaaattcaggttgttttaaaaagcgccaacagcctcgtggggccctaattttgcatcctgctatttgattggatgagtaattaatgcagggtgaggtgccgaggtggtgtttctaaacgtctgttgctaaagataaatgttgtaaattaaaaaaagaaaacatatggagcccagacaggttcctttactgctcctgcctggccatggcaggcttttataatgtaacccattctgctctgtcgcttcctgtttcaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagag

SEQ ID NO: 17360 - DNA, 1211 bp, Homo sapiens
gggctcctaatccaatatgatcggtgtcctttaagaagaggggagagagacacgggaagaacacatgaagatggagacacagtgatacagctgcaagctgaggaatgccagggactgacagccaccaccaccagctagggagaggcaagattcttctacttagagccttcagggagagaatggccctcccagcaccttgatcttggacttctagcctccagagctaggagacaatacatttcagcttaaaacaacagagcagtaggtgacacattcatccactgtgatctgtgccctaaagtgaaatctgatttgcttagaaatgtatcttatttgtagacctacagattttgctgtgactctgtgggtgaagtgatgctgatggtagggaaaggagtgttacattttggctgagaaaatcattaagggcatcaactaaggggtagggattgggagagatgcacaggcaagcattatctctgtatgccttggcaatttaaattgcagtcactctcatttttattttttttcaatttgcagcggaaaatccgccagagctactttgcctctgtgtcatatttggatacacaggtcggccgcctcttgagtgctttggacgatcttcagctggccaacagcaccatcattgcatttacctcggatcatggtaagcattttgaaattccctggtgagtcaaaacatctgaactttcctgtgaaacatgctttgcaaaattgccattgacataaacatgggtgtgttctcttttgtgaaccagtggttcacaaacaaagtgggatcctggggcatttttatgatcagcttgttagtcctgagacctctgtcttagatgcttgacggataggtgtgggtgggtgggggagggtcttgtagcaacttttttttttttcttgatgaatgcagcaggaaccctccatttgtgtggcagagctcttgtaacccccatttttaacctggagggttggaggacttttagtttgggtggagaggatccagaacaatcctggcagagcccagcaagctcttcacgcctggctccagccctcccacccctatccccgctgtcttctctgccgagagcctgggcttttcaagtctttatctccccctaaggctgtttcctacttttccaaaaatgaaactatctttttaaaagcattttttaaattcttcaacattccaagagcag

SEQ ID NO: 17361 - DNA, 1237 bp, Homo sapiens
gataatgaggctttaatgagcttccctagttagcagcatttcacatgtattgtcacacaactcgttgctgggagaagtaagtatcctatgtgacttccctggaagaggacttgaagcttgtgcctagtttcctctagactttgcctcatgtgccttttttctttgctgagtgtgtttcactgtaataagtcatagctgtgagtgagactaaatgctgaatcctatgagttcccctagtgaattgctgaacctgagggtggttttgggaacccaacacctcaccacacttttctagccaggcaggaggtggggacaggaacagaagggcgtctgtttgtatgaaggaagagagttgttgctgctcagtttgtaggaaacagaagtcgtatgatttcattgccattggcatctcatgagagtaacttaaggctggacttccaggtcagggccgagcacgtggggaatgctagtgagccaccactcaaatgcatcccaggcttagagaaaaggcagtatagacagtgatagagccacaagcttgtgcttttgctaaaagagtgacaactttgtggctttgtgtttttccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcaggtatcaaggacatagtttggggatgtattggacactgatgacatagtgtcgtaggtgaaaccactcttctcagtagacacaactccacctataatgtcttattaagagctttctttgtgtgagttatcaggcaaagtgctggggtggaggtgtcctataggtatttaggacacaggcagtgttgcctggatcaggactctcccaaccagtgtcttactttctaaagaagggaatgtccagagagttggtgacttgttgtgtgtggacacagaggtggggaaccagcctgggtgaccgttcctaacccaggggatactgttcaggtgacagctcattaattgtagagtgatgggcaactcccgagcagcccagaatgcttggtttgctggtacttgcaggttccctctgtgggaaagcccatcctggctagctgtcactctcagggggtggcttggtgaacaggcccttggtgcag

SEQ ID NO: 17362 - DNA, 1903 bp, Homo sapiens
accagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattttacacgtgcatgatgtgtatcttctttgctggatgggccaggaaactggagtggtcctctcagccagcctcagaggaaagaaatctctagctggcacaggcagccagtgagtgaggctggcggctgcaggggcacagcctttaggatgagtccttcagtgcacaggtcccagggtatacggggtagtgggaggaaggaggggacgcctcgcagatgccactgttggctgggctacaccttgccacacttgttactgcttaggaggctttctggagtgttccttgggtgctacgacaatctgcagcagacactgtcctttcaccgctcctggtcctcgtttgctccccagtgatgtcaacagctgaggactgctcacgctgcaacaaaaggctctgcagtcgctgtctagctggccctagtcgtctctagagttctgcctgaactgaaactcaagtggggttcagctcatgacttgtggcaattgaccaggaaattcaccagttgctgtggctggaaggattttcagtcct

SEQ ID NO: 17363 - DNA, 1171 bp, Homo sapiens
tcggctgacacattttcaaagatagtgacacgtgtgaggaaatgtgtacattaggtatttcttggtgaacaaatacttagtacttgggtgtttagtactctgtgttgtactttcctgtatgtgtcaatgaggcagtagttaaggaaagtatgtattatggtaaactttgagtaaagggcttatttacaaatcagcagtcacagcagatgggtggaacacgtgagttctcatgacgtgcgtggcataaagtgtaactcaagtctctggttctctccagcagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttaaaatcaaaggggatatatgtttgtggaatggattttcctgaagctgcttaacagttgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgccta

SEQ ID NO: 17364 - DNA, 1105 bp, Homo sapiens
ctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcgtagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcag

SEQ ID NO: 17365 - DNA, 1389 bp, Homo sapiens
ggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggat

SEQ ID NO: 17366 - DNA, 1186 bp, Homo sapiens
cacccactaggatggttataataatgataaaaaagggagctctttcctttcgctgctgcgactacagccatgagtatgctcaggcttcagaagaggctcgcctctagtgtccttcgctgtggcaagaagaaggtgtggttggaccccaataagaccaatgaaatcgccaatgccaattcccatcagcagatctggaagctgatcaaagatgggctgatcatccgcaagcctgtgacggtccattcccgggctcgatgccagaaaaacaccttggcccactggaagggcaggcacataggcatagataagtgaaagggtacagccaatgcccgaatgccagagaaggtcacgtggatgaagagaatgaggattctgcacctgctgctcagaagatactgtgaatctaagaagattgatcgccacatgtatcacagcctgtacctgaaggtgcaggggaatgtgttcacaaacaagccgattctcatggaacacagccacaagctgaaggcagacaaggctcacaagaagctcctggctgaccaggctgaggcccgcaggcctaagaccaaggaagcacggaagcgcagtgaagagcgcctccaggccaagaaggaggagatcatcaagactttgttcaaggaggaagacaccaagaaataaaagctcgccttttgtctgtacatactggcctccgtgaatacatagatcagccattaaaataaaacaagcctttatctgcttgccaaaaaaaaaaaaaaaagataaaaaaggaaaataactagtattggtgaggacgtagagaaattacagtcctggtacattgcaggtgggaatgtaaaatggtgcagtcgctatgggaaacagcttggagatttctcaataagttaaacatagaattaccatatggctcatcagttccactcctaggtatacagccaaaataattgaaaacaggtattcaaacaaatacttgtacatgaatattcatgtacataatttttttttttctctgtcacccaggctggagtgtaatggcacgatcttggctcaccgcaacctccgccttccgggttcaagcgaatctcctgcctcagcctcccgagtagctgagattacaagcacgcaccaccacatccggctaattttgtattttaagtagagacagggtttcaccatgttggtcagg

SEQ ID NO: 17367 - DNA, 3863 bp, Homo sapiens
ctggaggctgctctagccctgaggacttgccctgggacgtgcttccagttagaaggcttgtgtccctaccccagtgaggccaccagcttggaccactccaccctgtggctggggttttccatccttccccctacctcacaggcccgttggaggctgactgagcaaatgcctgcgaagtgcttgaattgccggggagccagcgaggtttgccttaggaagagtcttctagaaaggtgtaggttataagggagcagtcttagctgaggccctcatatgcctctgatgttgagtctccacttggagagtcaatctcccgtcagttgaccctttccatcctctcgtcctccctttccagagctccctgatgccagagatgctggtgaatgcaggtgacattctacctttcgtttccttgtctttccctcccctgggccttcagcattgcactcctgcccttcatcacaaaggggtttttggcttaagaggcccctgctttttccatgttgggggacctggggaagcctgaagctcggggctagccctggctctcccagtatttcttcaagtaggtgccagagtgtgacctgggagcaggtgagaagaaacttatcccaatatgtctactcagttagcacagagccaggcatgagctccactgatcagagccaaagggagtttgccaagaaatgcccgctgcctttggcatctgagttgcagctgggtggtaatgggagagagcaggaagaggcccaaggcctggcccatggagggcaacatgtgtccttcaggggctgaggacaggccgtgggaagagtcacaggaggttgcttaaggcctgtgatgttcggttcagatgcttcatggtgttctgccaggtggggttgcaccacggtctctgggatggtttctgcagcacattgtagaaaaaagactgtacagcacacagcaggcatcactccttgcgatgcacacttggattttatgaatgccctgtacatatcttttcaaactctgtgtttgtatggaggtggatttgatacaatgctgactctttcgtggctacatttttgctgtttttggacttctatgtgtgtgtgtgtgtgtgtgtgtgtgtgtatctatgtgtgcacgttgccttttctcattgcttatctgaaacaatagccggtgtgcagctatatttgtaccaggagggatccggtctgaaaagaggaatgtcacctcccctcgcagggctgagtagcctgatgacagggccctgagcaaggaaacgtggcattaactatattggacacccaacccccaaagttgtcactgtttgcctccttgaaaaaggctttggaagaagacaaagcagctccattctgcaggtctccaccctatgcaacccccgctcacacgcccttttggcatggtgcccctggcccaggcttctgttctgtgggtgtcagcagctgaaagaaatctgagtactcctgggcatggttttttttttttttttttttttttttttttttttttttttttttttttttttttttgtgtgtgtgtgtgtgtgtgtgtgtgtgtgtgtgtgtgtgtatggaaagatgtgtgactattgactttgggtatcgcgggactagttaattagatgtttttcatttttcaaaaagaaaaggttttaaaaattttcttgaaatgtgactgtcacttgttttcaaccaaaaactttttaagattttttaaaagaaaaatcgaaatcctgtccctcccccgcttcccatcgcctccggttttcaaaatgaaagcacaagtgcaagagtggggtgcacaggtgcctggcgtgtacacaccacccacacagctgcgtccagccctggctgagggagacgcagtgctgagcagtcagccccgggaggcctctttttcaacttccaatcccactgccatgaatgtgaattccttagggtgcttccaaaaacaggagtctgcctgatctgttggacattgcctttttggtagcccgaatatgaggaattcaggacaggaaagtgtctttttgtcaagtagtcagagccggatgcttcccctctcccagtgggtggagcatcgcaacccccagccagagttgatcttttgacaacccagtgacatcccatgagaaggaagaaaaaaaattcaacactgcctctagattgttattttgtccaagagagagatcatggagagagtctctctcgctcacggaggctctgtctttctaggagtatgtgtgtgtgctgtctcatgtgtggacactcacagttgaggctgagatggatatcttggcagcagagctgctggtctaggtggcttttcagcttgacaagtaatgaagctccatttcaggacttcatcgattccgaaacaagcacagccccccaccccccgccacggaactctactaatactaatcactataattagctaatttaaaagtacggtaatcagactgcttgcaactattttaaaagcccattaatttgaagcccactacttcagaacttcgagaaaatcacaacttaagacaattcacagtagctgtgattctggctacataaaaatatttgaaatattcttccctttagtcaatgttcagggtcttttgtgtaagagaaatccagtttaaaatgagtacccttttcaaagaaaaggctcaagatattaaggatcccttcaccgtgccttcagctttgcagttcagcacttctcgtatgtacagggtgatctcttgttctctctccatcacagggatgttggatattgcagcctttcactctactccgttatttatcctgtgaataacatagtttgtgaactagactgcaatttaaactaatacacatgatgtatctttctaaatattctgtaaagcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaacacagatcttcaggattgggacaaatcccccagctgcttttgcctctcaatccatctcccctcatcgataccaatttcccaggcctgaacacatctgttattttgctctgacattgtgaatttgtgacagtggaaaccctgatatgtgcaactgagcttatagaaataattactgtgaaatggattaattttgataccactttaaactgtgcttgtattcatgtgttgacccttgtcagctgggaaatctgtacattcagtatatgtcagcatttcattggagcctgggggcaacagacaaacttgcttctgatttctctctctctctctttctttttataattgttgaatttggctgttacattttgtctccttctttacaagaaaacaataataataaagagcaaatggcatccacttgaatcctgtcgtcatccatcttggatccctgctgactcccaaacttccaaggggtatgggtggttgtgagtcagactgtagataaggaagaagcccaaaacagtccaggagcaggaagcagacatgtcctgggtcctaaagtttgtccccagtgtgtaagatgatctcctgagccatccttctgggatgaggttggtgagatctgtcagaaatcacagttagaaacttggtttcagagctgggagaggagcggaaggtatacaatactcaggctttgccctggctgggcttcctaggttctaaagatggcaagg

SEQ ID NO: 17368 - DNA, 2200 bp, Homo sapiens
actcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtcagtgttaaagttttcttttgaagtgtaataacttggtgtattcagctgtgtgatttctttattcctattgcctgaagccattctctgtacaaaagtaaacaagtacttaatagcaagctctagacactgggcatgcacaggaactgtggaattctagacacatcaaatcttaatgaagaatattgtattgtggcggcagagagcgggggcggtccatccttctcatgattaccactgcagacagacagccacctagtcattagtgcccacttccagtgaccaggagctcagttccttacaagcccctgctgtctgtggttttagaagatgcattcttcagttgagttaaag

SEQ ID NO: 17369 - DNA, 3726 bp, Homo sapiens
agcccacatagccccgagtgagcagtgaggctgtctcctgccctcttctgcctggagggctcgtcagtgtccccaggtgtcaggccctgcctcctgacgttggccttttcactacaggcacccgaagcacacacagcagagtcctctggactttgaggaagaacccacagcaggaggaagtcagcagggagtggtgagatggggagatctttgcctggggagaacctccacactctaccctccccaaaatgacttggggaaccctgggaagaaaggactccatccctgcttgggggtgggggcagaggaggggtgcttgggggcgtaggttggggtgggcattaacaatgctctcatcccatttgctttgcaggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttccagtggtgtcttgcctctgctgtgtgaaactggggtgggaggtggtctgctggggatggggccacagtggccaggctgacatcgaggtgtgtgtggggcagggtctatgagggcctgtggggtgccttgggctgcatggagcctggcaacaggatgctggtggtcatgagcagtgactggctgggtaccaaaggcactccaggtgtcctcaggaataagtgacttggacattgaaggctgggcaaggggcagcaggtgggtcccaggcccctgatccctggcagcactgtaggggtgtggctcaaggcttccggaagggtcagagaggccacgtgtgcaaccaaggccagcaaccgaggtcagagaagagccccaggagggcctggacaggcagtcagaggccctgtgaagagctgtgtgcaggactcggggtggggtaggggctggtgtgtgccca

SEQ ID NO: 17370 - DNA, 1114 bp, Homo sapiens
gctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagatcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacatgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctc

SEQ ID NO: 17371 - DNA, 1383 bp, Homo sapiens
ccacctcccccaaggggctctggccaccacccccattccttccctgtgacccggatgaccacgtttgatacaaaatggggtggggagaggcgcccccccgctcccttgcacccagcacacccagccccagccccaaaccctgccgccacggggggctggcctggagggagccctgagtgggcagctgtggcctgggtgggggcacctgaagatgtctgcccccaacccaggccgtgagttgggagagacagggggaaagaggccctctcaaggttgccagctgcctgggtctctcaagaggggtcagcccacttgccatctccggggcaggctgccctctgttccgggaagctcaccctcacctgtgtgacccacgcgcccagcagacgcccacccactgctagccatcatttctgcgaaaagtcatgtactgtgcgcccatgcaggcggccacctctgggcccggggcacgtgctgtgagcttcctgcgagcccaggctctgcttgctgctgtcctgcatcgtgagcaccacctctgctttcctggcgtagatctaggccaggggctgcttgttctcgtggagctgcgtgtgttcttctctgagcagcctctccccggagacccccagcgcagtcccaggagatggcgggaaggaggcaccagggcacggcggacgctcaccccgtgaccacgatggtgaccctgactgcgggaagaagaaccggacccggggcacagcggggctgcgtgaggatccacaagaactatgctttggcgtttcacccctgttgttacttgtgactcagtttcttcagcctggtggggtgttccctggtgtttcccagtgttctgtgactgtcctgtgaaggccatagggatgggctcaggagggggctccctgaagccagtggacactgccagagtccactgtcctggcaaaaggcagaccctggggccctcgggaaggagggaggtggcagcgggggcagcagcgggagggggagcagatgacgtgccttgccaggaaccccaggaggagggggcctgggacctgtgtcctgtggtggctgtttacagtttctctctgtattgtggtttccttctcttcaatagtttcagtatatgtttctcttcaataaatttcattccgtgttccagccggtctcgcctctgctgtgggaaactaggggagggggattggctggggatggggtgggcatggaggagaggaaaaatattcctgcccagcacccctgggggacatctccaaaaagagtgtaagtgagagcactttgaccagcatgcgagggcacgacaagggcttttcttatattttataggtgaattgtcaagttttggggtttcattcgtccttagattgt

SEQ ID NO: 17372 - DNA, 1195 bp, Homo sapiens
gtgaggcaggagcagcaggtgagggaggagcagcaggtgaggcaggaggcgcaggtgaggcaggaggtgtaggtgaggcaggagcagcaggtgaggcaggaggcgcaggtgaggcaggaggtgtaggtgaggcaggagcagcaggtgaggcaggaggcgcaggtgaggcaggagcagcaggtgaggcaggaggcgcaggtgagggaagagcagcaggtgaggcaggagcagcaggtgaggcaggagctgtgggtgaggcaggagcagcaggtgaggcaggagctgtgggtgaggcaggagctgcaggtgaggcaggagctgtgggtgaagcaggagggacaaatgtaacaaaagcctgggtccagccttggcgctgcaccctacagcctgtgctggaaaacagggcctaccgggaattgagacccttttccaggagggagcagccaggctgcgaggaagagtcctttgagagctgggtggagcatgccaaggatatgctgcagctgtggtgccatgcgtcggaaagggagaagaagaggtggctgctggagagcttgggcggcccggccctggaagtcgtgagcggcctcctggaggaagataccaacttgtccgcgctggactgcctggcggcgctggggcaggtatttaggaaccaggacactcgaatgacttcgaggctgaagttcctgacctgcacgcaggggccccaggaggggctgtttgccttcgtggtgcgcctggaaggcctgctgcagagggctgtggagaagggggccgtctgcccagccttggccaattacctgcgactacagcaggtgctgtcttgggcccgccccagcgaggcactccaggataccctgagagggatgcagctggagaagaggccacctggcttcctggggctgctccggctcatccgggagatggaggcatgggcagccttcccagcgaggagccagcagggtgtggcctgggcagcggccccagtggagagtgaagacccagctgctgcccaggcctccccagcccaggggaatgccagcgaggctggtcccggagcagaagatgctgccgaggccgcttctgccaccaaagaggctgcaaggggagcccctgccgctggggaaggtgaaagtgcccctgcaggccccgaaggcctaggtcaggcaaggcccatagaggtcccctgggg

SEQ ID NO: 17373 - DNA, 1150 bp, Homo sapiens
ggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagcctt

SEQ ID NO: 17374 - DNA, 1205 bp, Homo sapiens
cgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccgaggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgagttcccccgcccgccgcggcctcctcccccagcaggccgccggcccccgcccgacccccggagccgccgcggaggggtgaagtccgggcaacgggtggcccccgggcacgcgggggtcggggccgcccctcgtccgccgctgccgctcggtggccgggccgggcgcctccacccccctcgcagtcatgtgcctggcatggtggggggagggggccggcgatgcccgcgaggctgccccccagactcccgggctgggaggagcgattggccgccgaggtgggaaagcaggcctgcgccttggggtctccgcgaggtaaggagccctggctgcccccacgggtcgggcacacaagcggcacattgtgtgggccccccacgtgtgcacacacacgaacacacacacacacaatgggccactctgtccctccccctgccctcccctcccctcgcggccctcccgcccctccc

SEQ ID NO: 17375 - DNA, 2008 bp, Homo sapiens
acgagcaggtgaccctgggggcttcagcatgtcctcctctcctgcagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaaagcaggctcctgcttccgcctctgctgctctaaggaaggggtcggggtacaggaggcagggggaacctcctccagctggagctgctgccgtgagcaaggctctgctctggaggcctctgcggccggcacccttctggggactgggaagggggcagggaaggcagcagcccaggggaaggccttgtccccctggagccgaggcagttggggagagcaggacgagagtgagctggagagcagccacacccgcggggaagggtgggcgtaaagccatgggtgctgaaattttcaaaatgttaccccaagaatttgtcactgaacaggtgccttgtgtcacttgggccaggctggtagcagcagaggggataactctgcatcagggatcaattttgaaggtggagccaataggggttgtgcatgaccaggatgcagggctcaaagaggagt

SEQ ID NO: 17376 - DNA, 1372 bp, Homo sapiens
gtggcccaagtttgggcaccacagcaggtggggaggaagggtccagcctcaaagggggcacccatgccctctgtatggggcaggcttggcagatgggcttcgagggcacctgtcaaaggtgtgcagagttgggaagggtctgatcaggtcttgaaggggactggatgccttgctgttccctgcagccaggactcagcccccagtgaggtcctggcagtcctccctggctggcgttaggtccagggctttccctagagcgtgggccagggctgacgctcccaccctggcaggcctttgggtgcagctggggagggggccccttgttcacttgaatagctgttgttaggagagaggggaaccgaggtggacctctggggcatggggctggaggtggcaggggaggagtggacccggccaacctactgctgtgggatttctgtccctttccaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtacgtggtgcggtgtgtgactgcagctgtggggagggctctgctttctctcctgcctggagcccccaagcggccacagcccttcaacctgtttcccccactgaaggccaggctcacacctgttctcgaaggccttgccctctctgtcctcctgctccccgggctgggccaggcctcgcttcagggccacccgccgagtgtgtgtcctgtctgcctccctgggtgtgggcagcttgggaggctcagtaaaccggcggggcttccgggtagaggactcgcttgccttctctgggttcctgttcgtcacatttgggacagacagaacgtggcagaacgccactagtcactccctgcccccccccccgaaggtttgcaggatgacctctgactaatgccagctgggagaggagacttgtccttggcagtgacctggagctggcccaggg

SEQ ID NO: 17377 - DNA, 1141 bp, Homo sapiens
cgtccagagtgtggcacggtagccccagcatgcctgggggctgagaatgaggggagtgtgggagtggcgttcaggaggggagtgggcggctcccaagcggcctgcctgtctttggtctcccacgcatagacttaagtctggggcgttttcccccaataccacaggcctcgcctgctgctgctgtgtgcaaggcgtggttgtcattgggtctcgcttgcaggctgggatcttgctccctgtctcccactctcagcctccctggaggttacccttgccgagagccactagagttcctctccattaaagggactgggggatggcctctgtgtttcttttgctttatcttgagcttttttgtcagccctttccctctactttgggggcctgcaaaagcagaggggctttattttgagaagtagcctcctgtataacctcgtttgagatagatttgggccagtttctggtgtctgtagcagtcgggttttttccccctaattcctgtcttttcgtttctgttttcttggtcatttacatcatttcaagaactagagaaagctgaaaaccaggttctggccatgcggaagcagtctgagggcctcaccaaggagtacgaccgcttgctggaggagcacgcaaagctgcaggtcagccctcccgtattgctgcgcccagggcaggagagcagagcaggatgaggcagcccctgcgggtgcggagggaaccttccaggggcccaggggctggctgccctctccaccactccccctggccacctctgccctactgagtgggacccttcaccgggcaggaggggggtggcctggcagcagatgtaggcacttgccaaggcggccctcaggagtggcactggctcactaggctctgagccttcctaccttcgtgctcaggcgcagccatggtttggggcctggtcaagaacaaagaagcaggtgaaactctgggacccactgctggccttctttcctagggtgctggggagtgacgtagggcaaagatccctgggcaagtgagggcacaaggtgtcaaaaaggcaccttccctagcaggcgctagttgtggccatcacctgctgccctaggcctgatctgagtcctcagactagcttgggtgcaccaggccg

SEQ ID NO: 17378 - DNA, 1194 bp, Homo sapiens
cagaaggcgtccctctgatggggtgggagatccaaaagggtttctggggggaggtgaggattgagctgggtcgagaggacattccggcctggagaactgccacacagagccaggcgtgttccaggaatggtgaggggttaggtgttactagagcagggggccacgtggttagtgaaggaggagagctcactgagggcatgcgtgctggcagcaggtggcttaagcagagggctgacatggtcggatttgccttgctctgggaggtggatgggaaagccgtatggcagcagatagggaggaggcgccagcagtggggatgatggtgggcatgtttgcagttgacatggaaagtgctgggttgtggcttgggctgggggccaagagggctgagtccaaggcggtttgcctgcccaccactacagcaggggctacacgaggtggtcaggtcaggcaggacaagggaaggcccgttttggacaagctgagtctagaatgtctctggggacatccaggagccaatgtttagcaggaggttaggtatgagtctgggccacagagaaaaccctttcggggataagagtggctgggaggaaggtatagggtgtcagctgaagagtgcagaccccagagggagcagaataacagtgggaggagggtgttgcgaggggacctcaggagggtaacttagcagcagagcaaggagttcagggtgacctccggcctgggcggttaggaggccactggtggccctgctgctggcttggaagggcaggccttggccagcctaggttgaggaatatatgggagggaaaagaccaggggcttgggcagggtgactccaggaaggaggcagttgaaggtgaggttcctggggggagaatgatcccgggtcatccagcaggaagagagaggacctagaaggtgtgaaaaagaactatcgggctgggggtgcagtgggaggagtatgcccggggtgctgtgggggtggggagcgcctgtgagggttggcaagaggaaggggaaccggggcctggcagaggggagccccagactgtctcaaggctgggaactgaaggcctgggctggggctgagcagggccaggctttcggacacacacagcgtggatcttgcgctggactttgtgtatgccctggcctatcttggaagccctggttctcaatagccgggaaggg

SEQ ID NO: 17379 - DNA, 2571 bp, Homo sapiens
cagcagcctggagcatgaggtgtgcatggggggcccgagatgagcccccccagcgtcaagattaaggggagagcttaaggaaccagggacaggtgtacccttagagggcaggggctgtgcccgagggagaagccagaaataggcagacagggttgcttcccacggtggcccggtcgcgccagcttgtttggccagtgctgctcttcagtagcacatgggtctcttctccccatgccctcctcagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgtatgtcccctgacctctctgcgagcagtccagaagcagctgcagtggcctgcttgggcctgctctgagggatttgtggtccaaaagcccagctacccaccgaggtgccaccctaggcgagtgccctgttgccctcgaggccttgccagaacccacacttaggggaggtggggtgggattctgtccattttgctggtgagggacaggttagaattcagaccccagcctcctggggccctctgcacgccccgtccctctggctgactgttgcgatggccaagctggtgtcctattcctaaccccccaccaggaaactgggcgatgggcttttcctccagtgctgcagggaggtggcagcccgctaccctcagatcaccttcgagaacatgattgtggataacaccaccatgcaggtattagcctgcccagtgctgtccccctgccctgagtgccctgggcttctctcacccatgcttccgaatctgctcctcagccagccccctccttgtcccgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagtgagtgccggtggcagtgccgcggcttgccgcctttctcctgttcacagacttagtgaggcacactcatcccatccggttagcccgttcaaaatgcatgatttagtagttttttggatatccagggttgtactgccgtcaccaccaggtcattccagaacattttcaccaccccacgaggaaagcctgtccccataagctatctgtccccacaccttcccccaacccctggcacccgctggtgggcttttgtccctgtggagtggcttcttctggacgtgtcacaggagcagagtcactgcccggcatccttctgccctccacccactctccttcgtcttgcctccccaggctacgaggaacaccggcaagagtatcgccaataagaacatcgccaaccccacggccaccctgctggccagctgcatgatgctggaccacctcaagtgagtggctcccagtgccccgcaagcccctggccagccctccgggccccagggactgaaggctggctgtcccatcctctaggctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctagacttggcgtgggcctccctcactccaggcaccgatgttcagtccacactttattaagaaaggaatacacacactttctccgagagccctcacgggggtctcaggcagaacacgctctgagagccgggcctggctccagcgtctctctgccctgtggttgtggagaactggcgcccagcagggtggtgggagctgtcccgcttttcccttaaggcacggagagctggaggtggagccacagccgggcctaggggttgagccaggggtgctggaggcagtcagcggcactggcccgcttttcggggatgtactccatcatgggcagcagaaaggcgctgaactgtgtggcctgctctaggggccactcgtacttttccatgagtacctcgtacaggccccagtgcttgagattgtggatgtgccgcagctctcctgcgggcaggccagcgggcgtcaggctctgtccctgtctctggacctgccttctgcttaggccc

SEQ ID NO: 17380 - DNA, 1188 bp, Homo sapiens
acaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcggtgcgcgattggctgccgctgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcaggtagcggcccagccggggcttctttcttgcgagcctctgacccacggcaggtggtgttgggggcaggagggatgcgggggtccggcctttcagggtccgtcgctgcgggccgggccttcccccgagaggcaggcggccttgggacggggggaccaaagcacctcgcgcacgtttaccggcagccaggcttttccttgtctgcccatacgaagaggagtccccgagcctccatggtgcgcccggcccccaagctgcagcacggaacgtgacacatgtcccggctcccgctccctgcggggtcggaccggagcgaagctctgtagcgctgagcgatcgcggccaaaaacggggctggaggagccacataagctaggaagggacctcagtgaggagagggagcaagagcggggcgagttagatggggagccaaaggtgcgcagggccttgagtgccaggccgaagactggcttttccggagggccctgccttacccttaccagagttttcggcagagccgaccaggggtcccgtcgatttgcattcgtgaggggctgaggtctgaactccagagtgtgtttaggaggtggctgcagcagccagccccgggcccgggggccaggactggacaggggcggctttctccacattcccttttctgccgtccttcaggccagtagccttgctgcctgcaacgttttggcagcctaactggcctccctttccgcacactcctcatctgcccctcaggaattccctgaactatagtcagggacgtatccagaggacaagcctggccataaaacccttcgggggctcccctgcgccacaggaagcaggccca

SEQ ID NO: 17381 - DNA, 2729 bp, Homo sapiens
gcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttgaatcgtggcctccctgtgttcattcttattgggctggggaaagagttgtcagtttggggtgggagaaggaagaggggggcagggttagggtcaactgaaagccacgctgcagccctcggtttgtcttggatgtcaggagcagtgactgtgacctcccatggacaattgtgtggcactccaggagatataccagagtcgcctgagtcatttcagaggtgtcacagtcacagggtggtgaccagatgcagaaggctggcagaagcctgacttcagactagcctccaggcaagggccacggtcatctccatgggccaaaccgtaggtggggcccgctgctggcacatgccacagagaagtgggttccagccccatccctcccagcagggcctgatgccgtccactctggaaggcggaagctgccctccccatttggtgatcccacagtgcctagcaaggtgctcagtttgcagaaggcacctagtggatgtcttggccagat

SEQ ID NO: 17382 - DNA, 1221 bp, Homo sapiens
aggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtgtgtgagcgcgcgcacatttagagggtgtgtttctccaggtcctctggtggggatgtgagccttggccttttgacccagagcatcctgccaggcccgagtacaaggaaagagctttggaggtgggactccctagtctcatgaccttcagcagctgtggccccggggaaggaggccctggacttatgggagagaccctgccttggaggtctgcttggccacgctgaatgtgttttgtggcacaagccggggctgctcaggctcaaagctcaacagcagggctcccactcttggtggccttcagttctcttcccaccttcaccttcagactttctctccctaatcacacctgcttcgggctacagcagctccccagcatacccgtgggctccagatgtggacatccaactgctcattgggc

SEQ ID NO: 17383 - DNA, 1224 bp, Homo sapiens
agggccaaggccctcagccgccctgccggggcccctggtgtagggcggggtgggtggcagccccgttccccctcatcccagaccctccggccatcccagcttttcccaccaagcaggatcttgagaccagagctcccagcaggggccctggagggactggcccattcgagtggagggtcgcggcaggaacaagtgcgggggtcgggctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggccagtggtggggtgcttggggggagtgctgtcttggagggtcccggggatggtgacgtctgaagccccgtgcagaggtggggagatccctgagggctggttcccgaggctgggggggcctaggtcccatgtgggggctgcgccttcaagccccatttcccctaggacatggagaaagagcgagagactctgcaggcctggaaggagcgcgtggggcaggagctggaccgcgtggtggctttctggatggagcactcccacgaccaggagcacgggtactcggcgtgcttctggagtcctcagcagggtttttgcccttcctgaggccccttctcactctcaggcacctcacagatttgctggccccagaggggcaggaggggctggcaaggcccgttccagactttgctaaccctgccttcccacaggggcttcttcacgtgccttggccgcgaggggcgggtgtatgatgacctcaagtatgtgtggctgcaggggaggcaggtatggtgttcccagcctggaagctcaggcacacggcccatcgcctcaaaggtctccccacctcaccccagccggccacttaagccactttccctcccgtaccccgcaggtatggatgtattgtcgcctgtaccgcactttcgagcgcttccgccatgctcagcttctggacgcagcaaaagcaggtaggtgcccccttcctgcccatctcccagtgactccgtccatgtttactcaacagggcacatgtgcggagttcctagagggatctagaagcagcgaaggacttggggaggctcaagggtggtgtgtgcggggcgtcctggccttacccctggcatgccaaccccccaa

SEQ ID NO: 17384 - DNA, 1764 bp, Homo sapiens
ccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccactaggtgtctcactgtgtcccggcatcctctcaggaagcctgagcgggaaggctgagacctgcccgaggctcacgggagccccctggagggagacctgagctctggtgaaagcgtagaaggccccagagtgaggcctctgctgtggcctccggtctttggaccaagtcggaccagggtccagcaggttgcttggtagctgccttgcagggcaagggccaaagagccccttgggcagctgctgctgacttcctgtgtctggggcccagatctccctccctcccctcctgcactagaggataggatggggcaagggcctggcaggtcaccagcggcagcctccttgggtgggttggggggaggtgggctgagtcaagtacaccacgggtactgcagaggtggatcccttcctctggcttcctcttaaatgtgagcca

SEQ ID NO: 17385 - DNA, 1153 bp, Homo sapiens
gtcccgggcccctctgtgccggtaagagcccagggggccgtgttcttccccgccttcccggcctacgcccgtgcagttccacactcagacgccagatgtcgctcttgtaccaggcatggggccgctcctggtcccttttccggaccataaaagggcagcctcggtgcctgctgcggcaggaggcaggagcctcaccgtcccccgcatctctggggcgcttttatttctgggactggttctcatcgcgtgtcacttcaccgcagcctgtataagacatggcgggggtctgagtgcccatttgtccaggccagggtgactgaggacgggttaaacctgaccgggggtctcaagggcctttctcctcatgctggtcagagaaccactgtcccctccctatttaacatgggctggagctggcccatcaagaatgaaaacttaggcccacaaggaaaggtgagggctggcttgcttctcagccctgctgcctggctctggcccctctcctcccctctgacaggggcttctctccctttctagaagatctcatcaatgactgagactgccccaagggctctgactactgaagtccccatcccggccaaaataacagtgaccatagccaacacagaaacttctgacatgcccttctctgctgttgacatcctgcagcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggtgagtgccggtgcaaccctggggaagccgggccgctcg

SEQ ID NO: 17386 - DNA, 1147 bp, Homo sapiens
cctgtcctcacagcctcttcctcatcccagttgcctttgaggcaaagtggtgcctcttccctggcctctgagcaagtcagtgtcttgggggcaggggtgagtgggtcttacgtctgccagggccgttgagaagtggtcagtggtcccagcctgtgtggtgacagtgcaggacagtgggagggacaggcagacagccagctgcagcactaactctcctcctcgtgtgtctccccagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacct

SEQ ID NO: 17387 - DNA, 1194 bp, Homo sapiens
tcccccgacatatgagtgtctgcaagtcctcactggaggggaaatggagtccgggttataaggcgtgctgtgtttctgtttagtttacccttttctatcttctccttgctgccttttgtgtctaagggtagtgaggagatgggcagggctatggctgtgacttgtggatgttcattatagtctaggggcagcaggggcagccctcacagagcctgtctcccctgggccccactctcccatccaggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtgaggcactcccagccgtctctcagcccagtgtcctagtgcagtccaccccagcacgccacgcaggtcctcccgacaggcctgggaggggcagcatcggtggcatctaccagcctggtggtgacgttggtggcactttcctctggtgttccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtgtacccataggccaggtcccctgccacccctagattataacgaagcagggctggccttcaatccccatggcacagctgggtggcacagcagctcctctctcccgagccttctatgcaagcagctccagagtgccccagcctgtgcaggaggagctgctgggaaggagacagcagcagccttggcccaactcttgcctcctttccttcaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcaggtagggcagggcctgaggccacgtgtgggcgagggaccccacacaagtggaagcacgtgaggctcacgccgtccgtccac

SEQ ID NO: 17388 - DNA, 1583 bp, Homo sapiens
acaagatggcggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacgggtgagtgcaaagcccgctgggtcttcggctctttccctccctccatctcctccctctccctcctctttcctccctccctccatctgctccctccctctcctccctccctccatctcctccctcaccctctacccttccctctctctctcccctcctcccttacccgtccttctcccctctccccgtccccctcccccttctcccctcctccccctccctccccactgatcggcttgcccctcccctttgctgtgccgggcttcagtgcttttctctgatcttctccccgttcccttgtctctcccgtgtttgaggattggttttcgttagttaaaagaaagcccctagtccgactggtgagggagaggggctgtcgccagcggtggtgacttcagacccacaccgttacccagc

SEQ ID NO: 17389 - DNA, 1222 bp, Homo sapiens
ctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggctctacttgtggactttgttgcaccgaaagccttgagctttcctgatgccttacacttcagggttcttgagcgtccagggtcttgttactactctgggctggccacacccagcacttcccgtgtcaggtttttcctgatgtagtccatgttttttatgctattctaaatggtatctttgattttctagttcatcatgatattatacagaaatgcaattgatgctgggcacggtggctcacgcctgtgattc

SEQ ID NO: 17390 - DNA, 1138 bp, Homo sapiens
cagagcaccactggcccacagtaggtgtttaataaatctctagaagctactcgggaatctgaggcaggaggatcgcttgagcctgggagttggagaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcattccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtag

SEQ ID NO: 17391 - DNA, 1145 bp, Homo sapiens
agtgaagtggctgttccaggctgcacggtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctggtgagcc

SEQ ID NO: 17392 - DNA, 1624 bp, Homo sapiens
atgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctgggg

SEQ ID NO: 17393 - DNA, 1131 bp, Homo sapiens
gagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggag

SEQ ID NO: 17394 - DNA, 1104 bp, Homo sapiens
cacgtgtgcacacagctgctaggcccttgcctccaagctcttggtgacaacaggaggcacctggaggtgacaagcctgtgctgggtggccgaggacagggaggcaggccagtctggctctgcctgacctcctgtgctcccagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggtgagcctggggccaagctattggcatctgcccaacgcccggcaccacagccacctcttagccccacccactctgccttgcaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggtgggcaacccgggcccccggcccaccttcccaccaaaatgaggccagaaatcacaggatggccagtgtctgggagagcagggaccgcctttggggcgtggctttcacttctagagccacctccctgccacctcctggacccctcaaacaaagaccagggaggagctggaatctgctaagctggcctgggttggggaggtgctggcagctctttaggaagagagaactgtcaccccagaactggcttagggacaggagaggagagcaggacaccagcgggaggaagggggctgggacctgggactgaggacccctcttgcctcaggcaacaacatgctgctggtgggggttcatggcccaaggaccccctgcgaggagatcctggtgaagcacgtgggcagccggctctacagcgtgtcctacctgctcaaggacaagggggagtacacactggtg

SEQ ID NO: 17395 - DNA, 1130 bp, Homo sapiens
ctgagtgtgggtattggacccagggctggcacagatagccctgcctggcactcactcttcactttgaggtcacagggccacccaggctgttcgtgggaggtgggaggcccaaaggctgatgagccggtcttacactctttccctgcccaggtgactacgaagtctcagtcaagttcaacgaggaacacattcccgacagccccttcgtggtgcctgtggcttctccgtctggcgacgcccgccgcctcactgtttctagccttcaggtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctcaggtctaaaggctttgaacagaagcctgtgccccttgagcaccagggctgcggtttaaagagggacagcctgccaaggctgggtgctgcccacagggtggggcagccctcccttcctgccacctgggtgtgtgcgacggcagagtgtgggggcaggggcggggatgtgcgcctgtggcttgctgccccttgcaaatcagtggctctccctctttaaaccaagttggacgccagatgggtaagtgcgacccgcgggcctcttgctcctggggcctttccgtcctcccttgccctggctcaagcacccccatctaaccatgtctgctgtgcttccaggagtcagggctaaaggtcaaccagccagcctcttttgcagtcagcctgaacggggccaagggggcgatcgatgccaaggtgcacagcccctcaggagccctggaggagtgctatgtcacagaaattgaccaaggtgaggccctgtccctgcccggccgccctgccctgctggctggaagcaggctgagagtacaaaaggaaggtaccgcttctgtaagcagccaagacggggccccaactcctgggccccctaagccaggcaaccctttcccaattggtgacccaagccgctggggatgtggctcgccacccacagctattagga

SEQ ID NO: 17396 - DNA, 1183 bp, Homo sapiens
tcaccatcaggcctggggggtggggaggcaagtgtcacatccccccacgctgcagcaggactccgcctcaccgcgtccacacacagcaatgggggccggggccaggccagaagggcgcaggcagccgtgtgcccagccagatgctggcgttcagcagtgtgggccatggtgctggacgaggctgagtaggcaagggagtggctgtcaacacttaggctggagtgggcccttccttttcctcccaggcacctgggtgctactgtcgggcctctcccacatgggcacttgaggtggtcaggagaaaccttcctgccttctgagaaaccactcgccatcccagcttggaggggcagggcggggcaggaggcctggcggcctggctgtgcttggtggtggcaatgagaggcctgtgtgggcggcaggcggacgggaacaacctgaacccgagctcacacgctggcccccctttggggacccaccctgccccaccaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggtgaggaggggtggggggtaggtcagcaggggtgtctggcaggtcccggcctgttcccctggggcccctctgtgacaacagactctccagcagctctctgctttgccctgcaggctctggctggggaccagccctcggtgcagccccctctacggtctcagcagctggccccacagtacacctacgcccagggcggccagcagacttgggtacggcctggccagctagggacactggggctagccagctgggtgttctgtgagcccctagtttaccatgtgtgaggagggaccccagatcctcccactgtccctcacccatgccctgtgtctccactgcaggccccggagaggcccctggtgggtgtcaatgggctggatgtgaccagcctgaggccctttgaccttgtcatccccttcaccatcaagaagggcgagatcaca

SEQ ID NO: 17397 - DNA, 1501 bp, Homo sapiens
tttttttttttgagaaagagtctcactctgtcgcccaggctggagtgcagtggcgcgatattggctcacggcaccctccgcctcctggcttcaagcaatactcctgcctcagcctcccaagtagctgggattacaggtgcccgccaccatgcccagctaattttggtaattttagtagagacgagatttcaccatgttggccaggctgttctcaaactcctgacctcaggtgatccacccaccttggcctcccaaagggctgagattacaggcgtgagtgaccgcgccctgccctcctttttgtccttatgactgatggatggcccatctggcaggcagcctgggcccgcccgtgtccctgtttggtgagggcaggaagccagggcaaggggaggcaggtggaaagtcaagcaggaggtctgggatcggggcatagtgtggccttggctcctgaccccttcttccctcaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgagttgccctgccgtggggtatgtgacgggggacagggaccagaacccccgagccccaagcctcctctctgtgcctttgcaggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggtgcgtgctggggactcccacaggctggcagacggggtgggtggggtggcccgggctcctcctgacctggcctgcactcctccaggactgcactccgtggacgtgacctatgacggcagtcccgtgcccagcagccccttccaggtgcccgtgaccgagggctgcgacccctccc

SEQ ID NO: 17398 - DNA, 1373 bp, Homo sapiens
atggcggctaggtgatcaagccacccaagagtcagacaagagtgggtttttgggactagtgaaaacgacaagagaatgctaataggttcctccagtcacagaagcctgctgcgtggggtcctcggggaggtagcatccagcggtctttattataaatggagatgaaccaggtctcagtaacagggacctaaaacccagtcaaggctcacacaggaacaagggcccagtgcggtgagaatgaatgttccagaaaacaggctgggcctgtcccagcagcgagagcacagctgggtcccgaggccaggctctgtgccacagctcacactgaatgaacttgcccagtttggaatgtgcctgacttaggggccagcagggagggctgaagggtggaggggtgaggctgtggccttaacagctggcccgtggttggctcgccttcccctgccaggcatcgagcccacaggcaacatggtgaagaagcgggcagagttcactgtggagaccagaagtgctggccagggagaggtgctggtgtacgtggaggacccggccggacaccaggaggaggtagggccagctgctggcagcagaggccccgcagcgctccctttcagtggggctgctcttagcaaaggctcacaggctccttcccactgcaggcaaaagtgaccgccaataacgacaagaaccgcaccttctccgtctggtacgtccccgaggtgacggggactcataaggtgagcccttggccaggggggaggcttgtgacctcaggcagtggctggaggcccccagccctaccctcacggcccacccttctggggacaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggtgaggggaggctgccaaggcccagctggtctgtggggagagccgcactggggcctgggagctgagcaggtgcctcgtggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaaggtaggcccggccctgactgccctctgctgtggcactgcagtctgggcctcccacaggagggggaccccctgggccagtcccgctgcagcccgccccgg

SEQ ID NO: 17399 - DNA, 1091 bp, Homo sapiens
aacagttgtatttcccaaccacccagggccacccaccttcctcttcctcagccccagccccactccaggtcatgggccctggattctgggccagctggagtcagcctcctcctcctggttccccataggcccctgaggtgtgtggcggacccctgctctggcagctgtggacactgtccagctgttctccagagctgcccatctgcaggctgggtctgccctctgcccttcctctgggcccagggcttctggcagtaatcataccctgctggcatcgtgtgtgtgtgtctgtgtgtatctgccctcaccccaaagtctccttcacctctgaacaccccctgggaccctgggcagagagggcctcatccacatcctaccactggccaagagggggtgtctacctcctccttggcccctgctaccccgtgctgccagaccctgaccccaaagcctgggatcggcccctcccgcacagccgtgtgcccagcgtggccactcttctactcacagacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggtgagggggcgcagaggcaggagagactgggctggggtcacccatgggtggcccttgagggggttctgcggcccccagactcacagcctcccttgcgccacaggcctgtgtcctgactgggactcttgggacgccagcaagcccgttaccaatgcgcgagaggccatgcagcaggcggatgactggctgggcatcccccaggtacacccgcccggcctggctacagctgtaggggaccggatcggcagttgggagagactcggaggcccgatggctcctgttttctgcctgtgacaggtgatcacccccgaggagattgtggaccccaacgt

SEQ ID NO: 17400 - DNA, 1197 bp, Homo sapiens
gagcccaagtgacttagggaagagagccaccccaccccccgcaggggccctggggaaggaaagtcccttgtaaggcgcgccggctgcaggccaagcagtcccgcgccagacactgctcagcctttcctcgctctagggcgcgtttcctgcagcgccaacgcgaggctgcggggctgggagcatccttgcccaccccactgcccagcgacccaccctggagcccgggtttcgcgtctgatcagccgaacccgggggcctagtgggggcattccaacgggcggggcggggtggggcaggcgcgccctcgaagccccaccccacggcccctccccgcaggaggcccgccctctggccccgccctcctcccgcatttaaagggctcgctctctccgcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcggtgagggacgccccgaagcgccgggcgggcgggggcggggactccgtgcgtccttccatctccccgggcggacccctccaaaccacccccttccgggccgcagcgcaactcccgaggcctccggctgctctgctccacgcgggcctgcagaacaaaggcgcgcgggctggctggctggccggccgggcgtgcgaaccgctacgcgcccccgcccgctgcgccccggctggccggcgcccaggctgaactcacatcctccgcaggccgcgcctccgcggctgtgctcgcggtgggagtgggcctggggggtcgg

SEQ ID NO: 17401 - DNA, 1433 bp, Homo sapiens
gcccgggccgccgccaggcctccgcctgagcccgcacccgccatggacaactacgcagatctttcggataccgagctgaccaccttgctgcgccggtacaacatcccgcacgggcctgtagtaggtacgcggcggcgggcgggaccccttccgggccccctcctcgtgctccgcctcgcgacctccccgctgccctccccgcgcgccttccccggcccgcggccctgaccgccccgtgtccggccaggatcaactcgtaggctttacgagaagaagatcttcgagtacgagacccagaggcggcggctctcgccccccagctcgtccgccgcctcctcttatagcttctctggtgagagcctcgcctgtggggacagcctgggacgcggggaggatggggtcgcgagggtgtggcaggggggccggtcgagagcggcactggagaaaggggagggaagtctgggggggcaaacagttctgtctcctcctttcaatccagacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgccccccttcccaaggctacaatgacgactactatgaagagagctacttcaccaccaggacttatggggagcccgagtctgccggcccgtccagggctgtccgccagtcagtgacttcattcccagatgctgacgctttccatcaccaggtgagctggctggcaggcgtcctgtacttgggtacaacctaggggatcgcggctgtgtttggataaatccaggggggcactgggtacaaatggtggctcttgggcctccggggagactctgtgtgactagagcaccctggtctgggatctaggctcagactcttcctgagagtcctgggggcaaaaggggatgctggggcatgagcacaagtggcaaggccccatggataaagggctgaacacccagagccattcaggagggtgtgggttcctggcctctaaccaaaggtcagaggggactggctggggaagtttggactgagggacatgacagggccatggtggccctgccagccagtcccctcgccctgactctcttctgcaggtgcatgatgacgatcttttgtcttcttctgaagaggagtgcaaggataggtgcgtagtgggggagcccagggacgggctggttctgggtccaggctcctggcccacttgctcccctcttttg

SEQ ID NO: 17402 - DNA, 1106 bp, Homo sapiens
tgtttcattgaggtttggagagtgttgagggtaagctaacctgtcaccccacgcccccgagaatggttactgatagggagaggccttttccttgcaggagatggcgtctaccagaaggggatggacttcattttggagaagctcaaccatggggactgggtgcatatcttcccagaaggtcagcagggctgactgggtcgagcccccccagtatgagcgggatgggctcccaagcctcgcctctgtgctctctcaccagggaaagtgaacatgagttccgaattcctgcgtttcaagtggggtaagggctgctggtctctggccacagccatcctcccggcccagagatggccctgtgggcccctggctcccgccccctcgggctggcttgtatgggggtagatgggcgtgtttgtagcgccaggaaggggacaggtgctgagactaggcctgcctctcgcaggggcttgcccaagggagctgaattgaactggaggatgtcgggggtggcagtggccagaggctggcacagaagcttggctcagggcccagcttatgctaacatttctacctcccccctgggcaggaatcgggcgcctgattgctgagtgtcatctcaaccccatcatcctgcccctgtggcatgtcggtgagcctggggacggggacagagagatggcatctggggtggggggcctgggactccctctggtcccaggctgccctgctccaccccacgtctggccttctgtccactgtgctgcaggaatgaatgacgtccttcctaacagtccgccctacttcccccgctttggacaggtgggtggggactgctgaccttcggctgtctgcctgtctgctgtctgctccgtgtctcccactcagcactatggaggccagctgcaggaggagctgagcatgaggctacagcaggggacagagtggaacatagacagggacttcctggcaccgagacattaaaatgagagcagaggaagtcaggctggggcagaggtgggctgtggggtcaggacaggacaggtcatctacagcacaggacccaggaccaggaccttgttttagaggaagagtggcccctggggagt

SEQ ID NO: 17403 - DNA, 1223 bp, Homo sapiens
aggcagtgtggtgagtctgcttggaggtggggagtgtatgccacaggtaggctgcccaggaggcccagcataggggaagcatgaggcacagaacccctgtggtgtgactatttggagtggctgactctgggggcagggctaggatgagcactcaagtcctgcctccccattccaggggcagctttccatctcgtcctgtgaggcttgtgggtggcagacttggacactaagtctaaatgaccctaagtttgagggactaggaatgtcatcagggtttagggggcatcagggaaggcttcctggaggaaaggtctcctctggctgatgggactttgagatagtggacagggtgtcctgttgggaggggaaggagggcacgacaattgggttcaagtgtgacactctcccagggctgctgaaagaaggctggttgggtgtttctgcaggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggcaagggcactaggctggggaggactgtgccaccacaggtgaccttcccatcactgtgggtcgcaggtggggcagggagccagggtcaggtctgtgttttggggtggggatggccatggtctggttggggtctgggcagcgtgaggatgtaggaggtgtcatggcatggggtgctgttggagggggagttgctcagacttctgcctccccatgcttgcgagtctttggttgggaccttggttgttaacacctcaaggttacctgggaacctgtcacctcccccttgagcaaaacctctgggactttgtgtgggcaaataccaggccagctatctgagccatttatggggcaaccatgcccttctgtttgctctcgcccccaaagcccagcccaggcaccttagtgaccctaagagggagtaaaaggaggggcagtgagctcaggggaaccagaggaaggacccccatgctggtggcaagggggacctgggtcctggcttccagctctgttccgaccttgcaatgtgactggatcctca

SEQ ID NO: 17404 - DNA, 1341 bp, Homo sapiens
tcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctcccccctaatttattctaatttattaactttgacccaccctttctgagcctgcagccttcccgtgtggcctgagggctgtcgagtgagctgccccagcccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtgggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaatctctggatcttgatggttatctcccaaaagctgggtacctggcagggctttggctgcctgggttggggctctggcttagcttcactctggactgtaaaaggtggcattcttcaccagggaattcctcacccagagcacgctggggccaaattgacttaaagcttaaggctacccagtgagtcgatgctggcaccaggactgcagccctcagtgctcaatgcagggggagtgtggtggagggcgggtgtcaacgtggaggaagcagagggagcgggggtcctggcctctggcttgaaaggagagggcagaggggaccaggggccagcctcggatgggattctaagtgaagcagggagacgggtgccagttttcggcttaatgcgggggaactagggcagccaggggaccagcgttggggtcaccaggaggaattagagggaccggggccca

SEQ ID NO: 17405 - DNA, 1114 bp, Homo sapiens
tctgttgtccacagcctgccgctgcgcttctgggtgaatgtgatcaagaacccgcagttcgtgttcgacatccacaagaacagcatcacggatgcctgcctgtcggtggtagcccagaccttcatggactcctgctctacatccgagcaccgcctggggaaggactcgccctccaacaaactgctctacgccaaggacatccccaactacaagagctgggtggagaggtgggctccgccctgctgtgggtggcagagggcaggacctgcccctccctgggctgcctgtgcgaggcaggccagctacaggcaggaagcccgggggctggctgggcagtgagggcaggggttctagtttttgtgatgtcgcctgagtgacatactcagggtcccaacaggtattatcgagacattgcaaagatggcatccatcagcgaccaggacatggatgcctacctggtggagcagtcccgcctccacgccagcgacttcagcgtcctgagtgcgctcaacgagctgtatttctatgtcaccaagtaccgccaggaggtgtgtgtcatccccacagactcccagttacttggtcctgaaggtgcagccagtgacaaaggcaggagggttggtgggggttggggattgttcacggtctctcccctgaccagggcctggggccggcacaggtgatgctctctgggatcacaggtagatgctggaatttgagggacccaggagataagccactggctgggtacaaagtggccactgggcaaaagttaaagggcctgagcactggaagggatgggtcaggctttgtgatgagaaatagccagaggcaggaggacatagaggtgtggactttaggatggagtctgggctggacacatttgcaagcctgtggatggcatttaaagccctgagcctggatgagctcacagggaagccacaagtgggtgtggagggagaagcggcccaaacactgagcccagggccccaggacacaaagaggggaggggaggggaggtgcagcagccagcggggaggatgcctgagagcgcctggtggggtctggcaacctgagccagtgaggacccctcacaggtcagggagtggcagtg

SEQ ID NO: 17406 - DNA, 1199 bp, Homo sapiens
accctcactcacctgcctcttcttgagctgtcctgggccctgccacccgtctgggctcctttgtgtagcattatcagcctcggtctggcctctggcacctcacccttgccatggctgaccccacccattccaaggcggggtcacggtaccagcagcacttggggtgaggcctccaaagcttcctcagaattgtggctgtgccacgctggaccacagggtccccctcaagcatctcggggccctattctctctgagcacctggagggctggactcaggcttgtgccagggcctgacttgggcctgggggccctagaacactcctcctcctgagcctactgccaaacgtcctcagtgttgtctgcacctgctccgactccttcagccgccccattcagcgcccgctccgtccagtgcccgccctgtggggccaaggcggccgtgccttactactctgtgtcttctgcctcctctgaggaatctggccctgtctgacagtcccagaccccccgttctctcctctttagttgcatgagtttttctttgttcatggaatgttttttcctgattaaatgttggggaaatgccatccatgtggggctctgtccttggggcaggtcagtagacctgtggatgctgcatgagctggagccccattgtgggagaaaggaccactccttgcagggtcccagagggtttggggaggttcagggccatacccgacccatcagcaaaccccggtggctctaccttcaagacagattcaaggtagatagattctcctcccttccaccacccccacccagctctcctgtgccatcgtctatctctgcctggatgccagtctccctgcttctgccctggctctcttcagcctgttctcagcgtgggaggcagagagatcctgttatgatataaggtggatcatgttgcctcactgtttagaaccctccggcggtttcagctgcagccagctccttcaaaacctgacaattgcatactgtcgaggttgtggcacccatcatggtgcacctaccaaagtcttactcccaggcctgttaagtaatgcaggtggggagaaggtgacatgcaatttatttatttatttattttgagacagagtgtagctgtgttgcccaggctggagtgcagtggcaagatcacagctcagtgcagtctcaaactcctgggctcaagtgat

SEQ ID NO: 17407 - DNA, 1150 bp, Homo sapiens
gaatcgcaacatggacgttgtgccacatctcctggggctcttgggtccaggtaagaaacggggcgggaagccgtccaggcaccgcagggcctcactggggcctccagggacaagggggaaggccccgccagcgcaggcgcgctaaggtcacaaggcgcgcttaggggcggagcctcgcggggtgcgcctctgggataggcgaccacggtgtcttcaaaagccccgtcagggttggcttcctggggccggaccgactgtgggtcagtttgcaccagcgctctggaatcgagttacgcgcgaaagggcagagtttctggaggaaaccgcagcctctcaaccgctgaccgggtctcagaaggcccccggcagggccgcttggcgggaactgaccacgcgccagtcaggctctccagggacctgcgcaggcgcgtgtgggcggagtcgtgcgcagggggcggggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccgcacatattgtatcctttccgagctgggggctgcttgcggcggagcgagggctggactcggggagaaggaaaggagggcgggcggggggccgacggaaagggtagcagggggggaccggggctggcgtatacggtcagaggtggtcggaggaggggaagacattgaaatggagggagaagctctgctaacggtggcctgggcgaggtaaggagtgaagggggtgacactaggcagggtgacctgagagggggcttcagaggagcaagaaggcctgagacataggcaagatcgtatcagatggcaccttaaccgaatgacccccagcaccctcagcgtgcctttcccgacccccttggaggcggaaatcgcccatgggtccctggcaccagatgccgagccccaccaaagggtggttgggaaggatctcacag

SEQ ID NO: 17408 - DNA, 1118 bp, Homo sapiens
ctgcaggaggccgagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagcgtgacccagagatggggtgtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtgggggcagaagcatgggctgggttccggttcatcctcctccaccctgccgtgtgtgtgggcacaagaggacatctaaccacctgctccttggaggaggcccccaggggtggtagaggctggaaggaagccacatcaggaggacgccactccggcccttcacccttgccaagtgagctgctcacagtgtggtcagggctgcgcgtgctggaggccctcctgcctgggccttgtggggcaaatattgggtccccaggctggaaagatggacagaggcccaatgggtgaaggctttgaagagcacacagaagcccctggccccccacgagagctggagagccatgtatatggcttcaaagccacctacggcagggacacactcgtgagcatgtgtggcctgcagttcaggtgatacatttaccagtgttcttgtttgtgtggtgccaggaaattgattttggaaaaagtgaaataacattaaaggtgaatgtgaggcttctacttttatccaaaaggagctatattagctaggctgtttctgatatccaatcattggtttaa

SEQ ID NO: 17409 - DNA, 1188 bp, Homo sapiens
ccgcgcggcggtaaaatacacgctgtttgttgtgcttgagaaccgagcagaatcgagagggtcttaaccaatccctttataccccgcacctcctctcttgagcccctgagaccccgagagcgaaggggacttgccgaccggggtcacccagcttggcaaggggagggctggagctgaactccagcatctgcaccatctcccatgctccaggtcattgtggagttcccgctacagtcgggaatgagatggtcctgggcacgcagttccatgccccacaaggattttactcggttgtccagaattgatgctgtagtcggaatacaccaatgctttgagtaattttgtaatgtacaccctgaatgaaggctgcctaggagagagtggctggagcccagagccagcagtttctaacccatcaaccactccccaatgcccagccgttcacaaggagtgatttgggcaatcaggtgtcaccctggtgtgagaccccagaggaactctcaagaaaggggctaacttctcaatgctctcctgttcttctgccttgttaacgagcctttcttccaccagacagcgtcatggcagagcaggtggccctgagccggacccaggtgtgcgggatcctgcgggaagagcttttccagggcgatgccttccatcagtcggatacacacatattcatcatcatgggtgcatcggtgagtatctcccaggccccaatcttaaaagccaggaagtgcctgctccatgcctcagcttttccaactaattgttgcagggccccacaggctctgctaagttgagctcctcctcccgctcctgctagtgcgccaggatcatcccggctctacctggtgtgcatatgcacttgcaagacttttttttttttttttttttggagacggagttttgctctggtcgcccaggatggggtgcagtggcgccatcttggctcactgcaacctcggcctcctgggttcaagcgattctcctgcctcagccccccaagtagctgagattacaggcatgcaccaccacacccggctaatttttgtattgttagtagagacggagtttcaccatgttgaccaggctggtctcaaactcctgacctcaagtgatccgcccgcctcggcctcccaaagtgctgggatgacaggcatgagccaccacgcccggctgcaggac

SEQ ID NO: 17410 - DNA, 1216 bp, Homo sapiens
taaggtatctgaaatgagaaccaagtttttaaaaaattggcagtgcactcaacactgttgtagaacacatgtccccacaatgttaaattgctgagtttgtcaacagttctcagtttttgtacttagtccatcttgcagacctatgccagtttgtgggccacatagtggtactgactctttttttacatgtgctcacgacatggtattttgttttgtgttgtgtcgttgctttgtagaattttgataagctgaatgtaaggacaacacactatacacctcttgcatgtggttcaaatcctctgaagagagagattggggactatatcaggtaagtgttgggaggaggcactgtgcaaacttactttcttttgaaaatgctttcacatcagctattcaggaaggcagtggcatgccagaatagctttgtcttgaatatataacctgtacccgcagtgaattatttttctttttaacttttcagatttgttgtttcactggagcattaagagtgggtgatacattaattttttttttttccattccaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggtatgtgggagagggagggaaggactggctagagtgaaaagctttctgtatttcccttctatgttttgtctgctggaaactatttcttcattaagaaaaaaaaaaatcctaaagcaaggatattgttttggtttctgtgtacgttctgtcccctgccagatcttggtggtccgcgctttttggaattccacatactaagcatgtattcatcaagctgactggatccatttgtccgggttcagctctcagcttgtcactccaggcttctcactctgtgctaccgcttctgcctaaagtatccttcgttcatttttatctgagaaaagcctgcttatcttgcaaggctttttccacgcagcttctacactgagtactcccaactgtccctgttagtacattgaattcccagtgagaaagtgtcttcattctttcccacatcatcaccatgaaatctctcttaatgcaaattttatagaaacacaaggt

SEQ ID NO: 17411 - DNA, 1073 bp, Homo sapiens
ttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtgatgcttttatgtttgttttctggtttttacatttttgttctgtatcttacacaatccaccttgggccctgtcatctgatgtgagatcaagtactcagaggcagtgattaccacaaaaccactgatctctagaagaacagagaaggagagggttaatgtatttatacatagtgggcctggcaggagcggggggcagggtgagtcgggagaacgaagctgagggtggggacatgcaggaatctgaaggccttggtgacagattagtggaagaaaggtctagggttgcttccgatttggtattaagaaccaagaaagaggccgggtgcaatggctcacacctataatcccagtgctttgggaggctgaggcgggcagatcacccgaggtcaggagtctgagaccagcctgggccaacatggcaaaacccatctctactacaaatacaaaaattagccaggtgtggtggcgtgtgcctgtaatcccagctactcgggaggctg

SEQ ID NO: 17412 - DNA, 1239 bp, Homo sapiens
agtatgatgcacagctgagcaacgctaacaattgctgtttaaaatctgtcactggcctctctgggctgggggtggtgcagcttgcttcatctgtggctttcttctttgcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaatgaccttgtaactctgggtttccacacaaaaagaaatgtggcccatttcacttaagctcctggacaacagcattaacacaagatgcctctcttgtgttcagatgataaacactggtgccctggaagagtccccattctctgcccccactgcagggctctactggctagtgcccatgtagaaaaacacccttaaggttgttgtagctagtggagcgctcattgtgggcacatatttagaacgagagaaaatccaagcctggggtcccgtggtacagtggaggccggtcgctgagccagggctggggcccaccctgcatgcctggctcatgatatggctacagctcagggcctcgcctcgctgcatccaagagcgcttttttttttttttttttttttttttttttgagacagtctgttttgccaggctggagtgcagtggcaggatctcggctcactgc

SEQ ID NO: 17413 - DNA, 1099 bp, Homo sapiens
agaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagcttt

SEQ ID NO: 17414 - DNA, 1178 bp, Homo sapiens
cagggtctcactctgttgcccaggctggggcgcagtggcatgatcatggctcactgaagcctcgacctcctgacctcagcctcccaagtagctgggactacaggcacgcaccaccatgcctggctcatttttttgtattttttttgaagaggcagggttccaccatgttgcccaggctggtggcaaactactgggctcaagcaatccacctgcctcggcctcccaaagtgctaggattacaggcacgagccaccgtgcctggcctccacttggctgtcttaatggcacataaaaattaatatatctaaatctgaaatcatggttttcaatctaaactatattcccttccaacatttcttacctcagtgaatagtgaatgtaacatccatttgcacaaaccagaaaccaaatagacattcttaacatctctctccatcaccttctaaactatttatattgataaagttacagcgatttgaaattctttttctagcctagtaatctgagtaatttgtaggataaacatgttgggggaggggcaggtacatggaggtgtcaaagtgcctgatggctgaggaagcaggctgggattactgcatggaggtgtcagagtttccagctttgtggctccatggttgggtggaggggcagggggagagatccagtggaagccatgttgtgccagtgccctcagggcgaggaggcagccagcagtgtgctacattaagcaaataactaagttgattgagtgaagaagtaaatctgttgaggaaaatgggagctaggtttctcaatgtcagagaaattatttgaaaacatggaaaggccaggcgcagtggctcacgcctgtaatcccagcactttgggaggccgagacgggtcaggagattgagaccatcctggctaacacgctgaaaccccatctctactaaaaatacaaaaaaaaaaaaaaaggttagctgggcatggtggcaggcgcctgtagtcccagctactcgggaggctgacgcaggagaatggtgtgaacccgggaggcagagcttgcagtgagcgaagattgcgccactgcactccagcctggacggcagagcaagactctgtctcaaaaaaaaaaacaaaacaaaatcatggaaaggaggaagggtaaaatgaatctcatggtattggattaaaattgg

SEQ ID NO: 17415 - DNA, 1767 bp, Homo sapiens
ctgacagttgactaataccatagtaaacaatgggttaacaattaatttgagtccttagttttgatagagtttaattatagtattttcctaacaattgacattatagcaggatgtcttacaatactatttgttaccagtatttgtatatgtttcatttctgtgtctttgattcattgtgtgagtggagtgaatacttagtcattgcatgcattatctttagaattgcatttgcattttctttgacaattcttgcagatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactctttgtcttactatgtttgggctgctataacagaataccacagagtggggggcttataaacagcagaaatttatctctcccagttctggaggctgggaagtccaagatcaaggtgctggcagatttggtgtctggtaagggctgtgtcctggttcgtaaacggcaccttttcactgtgccctcatgtggcagaaggggcaaggagctcccttgggcctctttaatttggcactaatctcatcatgagggctctgcccttatgacctactcacctcccaaaagccccacctcctaataccatcaccttgggggttaagattttaacataacaattttggggtgacacaaagattcagacaataacacctttttaaagttaacatgggtcttttcacgtatttgtaaagtttacttgtacatatactagcatgttccaagaa

SEQ ID NO: 17416 - DNA, 1162 bp, Mus musculus
accgccatgcagggaccacttacccttagggctggagagcgcatagcccaagccttaccactcccactattcggccatttcccttatatgaaagaggagcgaggaccttcctccctgggatcctcagaagtctactgggcacagaaaataactgattcatggcccatgccgactttgtttctagaggacaaacagtttcaagggctcctggataccagggcagatgtgacagtaatttcctcaacacattggcctgcagcctggcccttacagcccactaagggatggtgtaatccactgatcataaaatttacttctaaggggagaaacttagaggcttgagaaagttctcgccctctcacctggggcctaagattgtatcaagataactatgacaatggcctgacctttaaggttccgcttctaacaatcataaagcatccataggacttccaggtacccgccccctgttcctgccccagggtgtgctacgaccctgtttcagcccactctccctgtggggaggccccccctcttccactgatttactgcggtctatattgaatgcttctgctttagccttgttgtataagacacaaagagataatgcgtcagaatctgaagattgttggatgtgcttttctgcttccccgcacttttatgagggcatagccttatttaaaaattttaccctgctttcagacgctaggcagcttccccttgagtcagttcagcttaccttgacagaactctctggcgtaagaagttgtgtgttgggcccaggcatgcttcgaggcccttgctagagatttacaataacacatttagagtaaataaaaatgggttttaaagagacttcgtaaaggtcaaaaaattcatagattaggttttattggaagttaagaaatcatttcctaaaacatatataattcattttgtcaatggtgtttttgttggttgcagaaaatagagagcgtttttacagatggctataaaatatttaactaagtgtggactaataatgacttcaaaaaagatttagcatggtaaaatttaggctatttgaagcatttagtgtatagagattgtgtgttttctcaaaaatttgccctcagattaaataaattaaaagttttagatgcttgccagaaactgttagaaa

SEQ ID NO: 17417 - DNA, 1270 bp, Mus musculus
acctgggcaactgaagaccgagcctcagctaaagaggctcagctgtgttagactgaagttatctatttgagacacacccttcaaggtggaaagcagtggctaaagaaagccagaaaaaaagactaactcagattcccaccccgactacaccaaagcaagtaagagaattcttgggtactgctggcttctacagactctaaatacctgggttggcgaccttagctgccctgttgtaccccctaaccaatgaaggggaggtgttttgtggactccaaatcaccagaaagcctttaagccttactcagactttgggactttaaaaaaggccagtggcttacctatccaagaagttacaccctgttgccagcaggtggttttcttgcctgatggatgatgaccaacgctcctgtgacacatcagaacttttcgttgactgaacgagtgacctttgcttcattccacctgctgtcccactgtgtgagactgcacatagtcatcacttcgctgacattctggcagaagagctggtacactgatggcagtagcctcatggttaaaggtaagcagaaggcggggacagcagtatggtggtgagcagaaagcaagtgatctaggccagcagcctccctaaagagacatcggcccagaaagctggacttgtgactttaagacaagctctataaatggcaaaataaaagtctacactgacaacaggtatgcctttgccactgtatggggcaatatacaaagagggctgttgacatctgcagaaaaagacctaagatgctgtggctaaaaaaaaaaaaaaaaatcaggtggcagatctcaccgccaaacaggtggcccaaggagcaatgatcctggcagtcaaggagcctaaagattattatgacatcagagagacaagctttagatacaccgctgagcactatcaagttatggacattatttgacccacctgggggccaagaaattcaaaggtgtggttaggtcctttgactactatgttacaggactctctgacttggcagaagaaatagtcaaacgctgcaaggcctgtgctatgatgaggtagaatttctaaaagaaatctttccaaggtaatggacctgtctttgttgcccaggtaaatcagggactggcaaagatattagagatcggttagaagttacattgtgcatgcaggccccaaagctcaggacaggtagagagaataaatagcaccattaagagacccttaccaaattaacagcggagactggtgctaatg

SEQ ID NO: 17418 - DNA, 1180 bp, Mus musculus
gtgggcctgagagcgctcttgaataaaaatcctcttgcaatttgcagcaagaccgtttctcgtcggtgattttggggtgtcgcctctcctaagtcagaatgtgggggggtcctcacgttgtgggtctttcatttggtgcgttggccgggaaacgcgaccacccctcacacccgagaaccgacttggaggtatggggatcccctcttgtgtgtgtgctggccggtgtctctgttttgagtgtctgttttctgaaacgaacattggaacatgtgcttgttgtgttgggttgtttgtgtcttgtcctatgtttctgaagcacggcgaagtctgagtttggatccatctgagtttattgaatttgtgtcttggtttcagggttacgagatcgtgggttcgagtcccacctcgtgccttggttttacacctggcagagtgaggaacaagtgtgctgctctggttttggtcatctaggtagaagtggacgacggtgtttgtagacgatggggtgatggggttttctgaaatgcgctcgcggtcggtatttgcagctgtccttttgggccgttaggaccagaggactgtggttggcagacgtgctaggaggaccacaggctgtggccctgggggacgccctggaaggtaaggagagccagggacgcctggccatctccggatcggtcagagggaccaagttctgttgaagtggaagcttccccctccaacatcgtctaattcttttgcctgcttgtggaggacaagaaagggtcgaatgtgtctggatctgttggtttctgttttatgtgtttttgtgtatgtgtttagagctatgcgaaaatctagagaagcaaaggtaattctcataggtgctttatacactgattagagatagtttacacctgagacgtgagagaatgggttttaagaaaagcagtacttactctccgactatctggggataacttggtaaaaaaataaaataaaataaaataaaataaaataaaataaaataaaataaaataaacagtattaattggtctttggaaccctgcacctgtagttagaaatctagtgtggctagagaagccctgctaggcgctgattataaacgctgctcttatagggaccagcagcttctcaagttctatggtaagggatcagatggctgtttttcctacaaaaa

SEQ ID NO: 17419 - DNA, 1174 bp, Mus musculus
ctattggaaaagccaaaattgaaaggcaagggacccacatcactgtagttgcccattcaagcccagtgggccactgcctagaagctgcagctgtattgtctaaagagggaattgaatgtgaggtaataaatctgcgtaccatcagaccaatgcacattgaagccatagaagccagtgtgatgaagacataccatctcgtgactgtggaaggaggctggccacaatttggagtaggagctgagatttgtgccagaattatggaaggccctgcattcaacttccttgatgcccctgccgttcctgtcactggtgctgatgtccctatgccttacgcaaaggtcctagaagacaactccgtacctcaggtcaaagacatcatatttgcagtaaggaagactttgaacatctaattcggactttgaatgtaaagtcattgaaatctatttaaaatccttggtgggacttcacctgatgtgtactgcgagactgctagtcataaagttaacgctgaagtgacagcaggtgtctgaactgtaagaagtttcaatgtgcttatgagtggaatgttttccactccctaccctagatactctgctttctttgtctgttactgtttaagttaaatttgccctctttcactagaaggggcaagataagaatgcccccacagaagataacttatgtgtctaagaagtatattatctacatttgctgtttaattgttttgataaggaataaaggggattcccaccaataaataaataaataaataaataaatagaattagttttcttttgagtaaaaaaatgaaagcttttaaaataattaaatttgaataataaatttaaattcttcaaaaaatgtattttgaagaagggaatacatgtatgtgtacacacgtgggtgaatgcacacatttccatgtgtgcagagagcacatgaggatgtctggtgtcacacaggccgtttctgactaagtcagtgacccccaagcctcagagcatcctggattcactctccacagtgctcaagtcacaggcatatgcaattgtggccgactgtttatgtaggtggtgggtgttcaaactcaggtcttcactgttgtacagcaagctctgtttaccactaagtcatctctttggcccataatattcattgtcattttgttactagg

SEQ ID NO: 17420 - DNA, 1154 bp, Mus musculus
tttctttttcttccctctatgttttatcttcctttttctaaactattacgaatgactttccatgcgaagtaggtagttaagtaggagaacccactgtgcaagcctgacctgagtttgattcatggtggaaggagagcaacttcccgatagttgtcctgatatacagcatagcgcatgtgaaagcccctccatgacaataataagaaaatgaaaagaaatgtaaaagaatcatttccattttgcttacttaagcccgtttaactacaaagttcttggaattaacttctcatcttaggaaatctaaaatgtgtaacagttattacctatagaaccaatatttacatctctttctaaaaaaaatctttttagaaattctgtgcaagcctattccattctttctgcggggacaaccaattccgaaaagaatgcttccccctgagtcactggtgccctattacaccgatgcaaaaaaccggggctacctggctgaccctgccaagtttcctgaagcaagacttgaactcgccatgaagtttggctacgtccttcctgatattacgaaagatgaactcttcagaatgctcagcgctcggaaggatccgaggcagattttctttggtcttgctcctggctgggtagtgaatatggcagataagaaaattctaaaacctacagatgagaatcttctcaagtattacagctcctgaactgccttctactaaatcagacttgtgagccagacgggctgcacatggattcttgtgggtattaaagctttgggtctgttaccagccttcactgctcaggtcttttgttctttttccatcttaaatagcagacagcaaaagctgcacgagcgactgagcctttgagggtgtgtgcttgaaaatctgaacagtggcaggctttagaaaggggattaaaaagaaaaaaacctacttaaaattacctttcttttggggggtggggagactgtgttttgatacatggtttctctgtgtagccctggctgtcctggaacttgttctgtagaccaggctggctttgaactcacacagttccgcctgcttctgttgggattcaaggcatgtaccgccactgcccagcctgactaagtagtttaaaacatttctttactgtccatcttttcatgg

SEQ ID NO: 17421 - DNA, 1171 bp, Mus musculus
agcctgtggccctgttccctctcttagaagcacactgtgcatctgccttttcctacccaaagcatttttctttttattgcttttattttaagtgtgtgagtgttttgcctgcatgtgcgtctgtgtaccatttatgtacctgatgccagctgaaggtttgcatcccctagcactgaagttagagatggttgggagccaccatatgcgtgctgagaataaaactctgcctctctagaagagcagcctgtgccattaactgctccagcctcccaaataatttttcttaatatctggtccaaaactgcacttcggtttcactgtctttctcactatcacctaagccttgcacaggtaggtaatttgttatagtttcagcaatgtcggtcctcacactgaaagctacttaatatctacacaatatctactgaaatcctgtttcagcggcagtaaaaaattctgttctatgaattcaacagcagttcataagcaaatgaactacatagctgaataggtcggtaacttagtgtccactagagggaagcatatgcccatagaagaaccttttaaatgccccgagactgtgaacctcagaaaagaattggcttgggagatttggtagactgcacctgtgatcccagtacttgagaaaccactgcagggtgttgctggatgtttaaagctaccctgagctacatagtgagttctaggccagccttggctacacttaaaatcctgtcctaaaacaaaagaaaagaaaacaaacaaaccctaatcaaatcacaaacagaggagttcatttggaaaagcaataccaacgatgtgattgagcctcaatattttactttggatgcgtaaaaaaaaaaagatatagctctactttatagaaaaatccatgaccttggcagtatttaaattgcatgtcttgatactcttcagttatgtgtgtattatgctagcagacattagcctgaaaattataccctggggcaatggttgaataaatgtacacacacacacacatagcttgtccattgtctttcctgagtttaaatatgtaaggaaatagtgggtaataaatgctgtgattagtaagcacagaattatttggaaatatatattctcaaggaaaatattgaaacttgatttgtagactttcctaaaaatgcagttt

SEQ ID NO: 17422 - DNA, 2386 bp, Mus musculus
catccttcttacattacctttatgtagtagtaaaacatcctcacctgcatggattttattagtggcattctcggaaatgtactttctgacttctgtagctgtttattaaatcattttttccaaacaggaaatgatggatgtcaagcacttcattgataagctcctacctccaattgattgacatcactaagaggccttgagtagaagttcaccagcatcacagtagtagagtataaacctcttcccatgactgaccatagaacttctaatgtgtgcagtgttaaaatgttttgcaaatacataccaatgatacagactaaatgatgttaccctcatgggaaatatatgatccttttaagtgtctatgcatatatttgtattatacaattcagaatatactaagtattacagtaggtaagtgaagcaactagattctttgtctcaaattcagcaaaataagataacaaacagttttattacatcatttgaaaattactagtatgttctgtgaagatgtgttcaggtaagatgtaagtgacttcttagttctgtgagttagactatagttttactccacaattgttcagtctccatgcagtgtctgtatttttctgtttgtattcacatagatgatactataatagctaagaatcagatggtattacattatccctaataatggggataatgcttttgagtgtcaaaaagtaatactgcattcttcaattaatggcccttctattgggagaccaggctttttttcccttctatgtaatttttctcaagaaaaaacaaggttcttttttgattttccgtagaaaactaatattgcctctctgtcatatattttattttgacattttgagatacagacatagccgggcgtggtggtgcatgcctttaatcccagcactcgggaggcagaggcaggcggatctctgtcaatagcctggtccacagagtgagttccaggacagccagggctacacagagaaaccctgtctcggaaacaaacaaacaaacaaaccgaaacacagacatacagtatttccaacctaggtaatatgaaaagaaatcaaacattacttaagtttatatatttcaaataactgcaccttagtccaactttagactgtagagttatagactctccagtcctggtaataaatctgtggttttatttttctgtaaaacacttaaaggggaagtaatatcttggcatatttagaaatacttgtgactggcttcaaaatataatttcttaaatatcttatagccgattttaagtttacattttctgtacatgttatgcttaaaaccaaatactgttcaagatgagcaatcagacttatgttttatttttatctgggtaacatattattttgaaattttcatcttaagtaaaggagcttttgataatcagtctcctgtacaaatattaaaataataatttgattttaaatcatcagcatgttcaaaatactggtgaaaattatttaatataaggactggttagaacattatatatatatcccatatttataactgttaccacacagttgaatatgttgcaaaaattatggttatttctgaacggttgcttttcttgctgttttccaaccaaccaagaagcacctttataaacaggtgctaattgatatgaagatcattttggtatgtcctagatagaatgaagccaaatgtctggatttaaaacaatttcaaacaatcatttactattttgctttactttaaagaacataaatttacttcagttattctatctgtaaagatttatttggtataagaaatattccattgactgtgtgctgtaatgtgggaaaatgtcatgtttttcacagtttctatcaatgtgaaataaaatttaattttggctttatcgattgctttatatagtactgtttcttttttcttttcttttttatagataggatctgtactggctagttttgtgtcaacttgatacacctggggttatcacagagaaaggagcttcagttgaggaaatgcctccatgagatccagctgtaaggcattttctcaattagtgatcaagggggaaaggccccttgtgggtgggaccatatctgggctggtaatcttggttctataagagagcaggctgagcaagccaggggaagcaagccagtaaagaacatccctccatggcctctgcattagctcctgctccctgacctgcttgagttccagtcctgacttccttggtgataaacagcagtgtggaagtgtaagcttaataaaccctttcctccccaacttgcttcctggtcatgatgcttgtgcaggaatagaaaccctgattaagacaggatcttactgcatgcccctgctggcctggaacttg

SEQ ID NO: 17423 - DNA, 1149 bp, Mus musculus
aaggactgaatttatgaatatagatcaccagggtttatgctacaaagacttctattatatattttatatttttcctttctaaacttgctatgtttgttcaaaaaactcttcataatgattcagaacaaagtttctgctgggcttttttgtgatttcctttgtctgtgtaattaatataaatctgcttaccttagcctcagctagactcttcagacaagggcaaaaatcaacctcgttcttcaccaaaatcgcacaaaaacaatctctaggccacatattgaaatcctcttgggccaggtctgtacagttcaaatcactctcagttacaaagtttttttttttttttttaatattcctattagaatagccaattaagccccacttaaagatatccactgctttccaaacacaaaacccccaaatctacattcttccaaacaaaagcaccgtcaggcctatcatagcaataccccactcctggtaccaacttctgttttagttagggttttattgctgtgaacagacaccatgaccaaggcaactcttagaaggacaacattgtattggagctggcttacaggttcagaggttcagtccattatcaagatgagagcatgggaacatccaggcaggcatggtgcaggaggagctgagaattctacattttcatctgaaagctgctagctgagtactgactttcaggcagctaggatgagggtcttaatgcccacgtccacagtgacacacctattccaataaggctacccctccaaatagtgccactccctgggccaagcatattcaaaccatgacaccaactgagccatttcactggcccctgcaattgattatttttaataaggaacagtgagccgagtgtagtgacacacatcattaatcccagcactcaggaggcagaaagagggtagatgtctatgagttcagggccagcctagtttacagggagttccaggacagccagggctacatagaccctgtctcaaaaatgtacaaacaaataggagcagtgaagcatccctctctattttctttttctgtttgtttgttttgtgacaggatatctctagttggcaaggaatgcatagtcctaccttcagagtgtgatgattccagctaggcatatgccat

SEQ ID NO: 17424 - DNA, 1176 bp, Mus musculus
cataacttctgttagtttcactgtgtccctgtatactttctgtttccacgatctgtccattgatgaaagtggtgtgttgaagtctcccactattattgtgtgaggtgcaatgtgttctttgagctttataaagttttttaatgaatgtggctacccttgtatttggagcatagatattcagaattgagagttcctcttcgaagattttatctttgatgggtatgaagtgcccctccttgtcttttttgatgactttgggttggaagtcaattttattagatattagaatggctactccagcttgtttcttcagaccatttgcttggaaaattgttttccagcctttcactctgaggtagtgtctgtctttttccctgagatggggttcctgcaagcagcatgttgggtcctgtttgtgtagccagtctgttagtctatgtctttttattggggaattgagtccagtgatattaagagatattacggaaaagtaattgttgcttcctgttatttttgttgttaaagttggaattctgttcttgtggctttcttttttcaggtttgttgaaggattactttcttgctttttctaggacatggtttccgtctttgtatttgtttttgttttttgttttttctgttattatcctttgaatggcttgattcacggcaagataatatgtgaattttgttttgtcgtggaatactttggtttctctatctatggtaattgagagttgggctgggtatagtagcctgggctggcatttgtgttctcttagtgtctgtataacatctgtccaggatcttcttgctttcatagtctctggtgaaaaatggggtataattctaatacgctagcttttatatattacttgacctttttcccttactgcttttaatattctatctttatttactgcatttgcttttctgattattatgtatcaggaggaatttcttttctggtccagtctatttggagttctgtagacttcttgcatgttcatggcatctctttctttaggtttgggaagttttcttctataattttgttgaagatatttgctggccctttaagttgaaaatcttcatcctcatctactcctattatccataggtttggttttctctttgtgtcctggatttcctagatgttttgagttaggatctttt

SEQ ID NO: 17425 - DNA, 1903 bp, Mus musculus
aatgatgagatgcaggccaaggggattccacaaagggctccacccaagaggaaaagaaagagagttaaacagagaattaatacttacgtatttgtgggtaatcagcttatccctcagcctctagacagtgaagaggatgaaaaaatggaagaagacagcaaagaagaagaggagaaagagcacatcgaagccatgaagcgcgaggaaccacctcagaacctactgagggaaaagataatgaagctgccactcccagagtctttaaaggcttacttgacatattttcgagacaaataacttaaacaaggaagaatgcctactgataaactcccttactcttgtaaatgtagtattaattaggacttagagaattacttcattagaatgaattattgcagaaaaaagtctaagttatttcttttaataacagaaatgatgtattcagtgatttaaaagagtctctttcctaagatctatttttcttaaatcttgaagaattactgttttgatctcaaagtgggatgggtcaatagtaagaactttgtatacagtactctttctggttcttcatggatttgtagtgttggcaattgaatttcattctataagaggttgatacacatattgtcacacatataggcttatttaaattgccgtttgcatttctgttacttgagcttgcttatctaataaggaaagcaaatgcttgtagacctacttaccttacttatgttctagacatattccgggcaacgtatgagtgcaatactaattcaagatactgagtaatttagctttaaaaaccacagacttcatgaaattttacagacccgaaacttaagcttttgaatctattgccaaaaggcatggggaaaatttctgcttctctcatagagatttttaagagctagtgaatgttaaagtaggaagtggctacttgacacaactagtttgtatgggccctttgtgttctcagtatttaaagataatgaggttatcttaactatagaattttaagcggtagtatatttaggattgcttttctataaataactataaagtattagatttggaaagtcattcactgtcccatttgcttctaaatgcagactgtgaataagtcacattaagtgatcagcactgcttagggacctccagcagcagggggaatgatatgatcagtagagacattttagcagtggaacttttcattaagtagatatttatctttgacaaggtaggccacactggcctcatctgctctgaatctttctaatataaatagtcatgggagttgtatgtagatgcgtttgtgttaaaacttgcttcagaatcagagtgggatctctgggacctataccaaactcattatccttcattctgtattttgtttctttgatagaatgatgatgattttcactttttgcttaatactacattcttaagctacttacatagggtatcagtgatacaccaggcagtgcatgtcattactagttctttcttcctggtagggcctgcacagttattcctggttaagaagctgtgggatgtgacctacttactgcttaccatcacacggaagggaagatttcaagtgtctcacttattcccaccacatcactgtcagagcaccctctcggatttacataaggaagtacaatcatgatgattcaaatagtttataactcaggtccaataattctgtgtaggtgatcagttaaaacagtttaaagatgaaattgacccaaataattgataatgttttaataatgtgaacaacagtgttatggaaaggattcgtttgactcttgtgaaatgggcctgtatgatttttcttaatgtaattagtaaacaaactattattaagatatgctctatcctgtttctgtccaaaaaagaa

SEQ ID NO: 17426 - DNA, 1248 bp, Mus musculus
cacccaagccaaggttaaaagcccactcatctacgaatgagaaaatcatttgatcacctcagttaagccttgccttatttaacttaattaataggggggagagagattggagacgtactattgaaagggcaagcccttcactgcctcccacccaaataaaaaagccaattggccttgtactacaagagctggtcgaactccttctccctgtttcccacctatcatccaaaaatgcggaggaatatcaacttagtgttattcttattatagtgtatttcacatttgttcagtcaaacttagccagagttccaacgccctacttaaaattcaactagaaagttacctaccaagtactaattagcattataaagtcagagcctacagctccaggcttttcagttagttgtttactaagataagaaaggacagtcttagccttatacagtttaccataagaaaagttaaggaatcccatgaaagcaagttttttctttagccctagctttttctttttttaaattttgttaataaaagggaggagatgtagtctcccctcccctagcctgaaacctgcttgctcggggtggagcttcctgctcattcgctctgccacgcccactgctggaacctgaggagccacacacgtgcacctttctactggaccagagattattcagcgggaatcgggtcccctcccccttccttcataactagtgtcgcaacaataaaatttgagccttgatcagagtaactgtcttggctacattcttttctctcgccacctagcccctcttctcttccaggtttccaaaatgcctttccaggctagaacccaggttgtggtctgctggccggacacaacacagtaagaggcctatgattggacagggaaaggggaggcaaagctatgaattttaaagacagatagcaactcaggaaagaggggagaagcaagatggaactagaaccacctggctttgaatagccacagatatgtatgttattatatagggataaaataatgtaacttgtctaatctaggtggacagctcttatcattatcaaattttattatttatcattatcaattttgtttattacttatcattatcaattttatcattataaattatctctgagattattgtatgggcatcttgtgaattgagaatttattgagacataaatctgactggttaattataagcttcaaaagttttcttttactgggttactggaatgtggtac

SEQ ID NO: 17427 - DNA, 1171 bp, Mus musculus
acgctcctgtgacacattatcagagctttttgttgactgaacgagtgatcttcgctccacctgctgtcctcaatctcgctaccctactgcccaagacttcacctactcatcactgcgctgacattctggcagaaggaactggtactgaaaatgatctgaaggatcagatcatccttggcctgagagtttgagcagtaccgatggcaacaccgatggcagtagcctcgtggttgaaggtaagcagaaggcggggacagcagtacggtggtaggcagaaagcaagtgatctaggccagcagcctccctgaagggacatcagcccaaaaagctgaacttgtgactttgatacaaagagggctgttgacagctgcagagaaggacctaagatgctgtggctaaaggaaatcagatgacaaatctaaccgccaaacaggtggcccaaagagcaatgatcctggcagtcaaggagcctaaagattattatgatgtcagagagaccagctttagatacacccctgagcactatcaagttatggacattatttgacccacctaggggccaagaaattaaaaggtgtggttaggtcccttgactactatgttacaggactctctgacttggcagaagaaatagtcaaaagctgcaaggcctgtgctatgacgaggtagaatttacggaaattaagtcagctagatatggaaacaagcacttattagtgtttatagacaccttttcaagatggatagaagcttttcctaccaggactgagacgaccaatgtgatagccaagaagatcttcccgaggtaatggacctgcctttttgtccaggtaaatcagggactggccaagatattagagattgattagaagttacgttgtgcatacaggctccaaagctcagaacaagatgaatagaattctaaaagagactggtctagacttggtgctccttccccatgcccataactgtcttaaatgatgtgtttaaacttacatgttgttgtaataataatctgtgtgctaagttaaaaggcttgcaggtggtgcagaaagaaggctggccacaattggctacagcaaacgagccggataccacaaaagaaatcttaccagttccagccagagatctgatctacatacacctacatcatgcccagaccctcaagcct

SEQ ID NO: 17428 - DNA, 1099 bp, Mus musculus
aaatcatttgatcacctcagttaagcgttgccttatttaacttaattaataggggggagagagattggagacgtactattgaaagggcaagcccttcactgcctcccacccaaataaaagagccggtcgaacgccttcttcctgtttcccacctatcttccaaaaatgcggaggaattcaacttagtgttattttcacatcgttcagtcaaacttagccagagttccaacgccctacttaaaattcaactagaaagttacctaccaagtactaattagcattataaagtcagagtctgcagctccaggcctttcagttagttgtttactagaaaggacagtcttaagccagatacagtttaccataagaaaagttaaagaatcccagtgaagcaagttttttctttagctctagattccaggcagaactattgagcatagataattttcccccctcaggccagctttttcttttttttaattttgttaataaaagggaggagatgtagtctcccctcccctagcctgaaacctgcttgctcggggtggagcttcctgctcattcgttctgccacgcccactgctggaacctgaggagcaacacacatgcacctttctactggaccagagattattcggcgggaatcaggtcccctcccccttccttcataactgagtgtcgcaacaataaaatttgagctttgatcagaatgaaattgtcttagctccgttttttcttccgccctgtctagattcctctcttacagctcgagcggccttctcagtcgaaccattcacgttgcgagctgctggcggccgcaacactttttggtggaattttggattttctccatataacagcacatttggcaatgctgcaaacttactgtatcttctgtagctcgtacacatttttccttatctaatctctcttgataggatatttatggccttgtttaattgagtgtcaaatgtggacatcctggtcttgttccaaatcttagaaggtcttctattactgttcattccactgtcacttgtgggtttgtgatcatgacctttatcatattgttaaatttcagatttgcatctgaaactag

SEQ ID NO: 17429 - DNA, 1351 bp, Mus musculus
agccaagcttctgtgcatgccattcttaatgcaattctccttttgtctttccatgtgcacactcccaaaggtctcaagatattcactctttacatgcgctctttgtgcttagggaatttaggagcatcattctgggaccttggtgtggtcctctggtcgagaccctgagtgattaggagcttcaaactagttctgtttttctagttacttattctcttttctgaaaaacagctgtctcatatctatagatataatagaacacctaggtctttctaggcacaaaaagataaatacaacttgttttaaagtcaattatttgttctctctctctctctctctctctctctctctctctctctctctctctctctctctctctctctccacctgtgttttggggccatgcattttgaccagctgcatgaccacttcagatattctgagaagtttgggatttcaggcatgaagtccaggaaagtccaagaaatggtctcaggagctgccattgttgatatggtccctggcaagcccatgtgtgttgagtgagagcttctctgaccatcctccacttggtctttttgctgttcatgacatgaggcagacagttgctgtgggtgtcatcaaagctgtggacaagaaggctgctggagctggtaaagtcaccaagtctgcccagaaagctcagaaggctaaatgaatattacccctaacacctgccaccccagtcgtaatcagtggtggaagaacggtctcagaactgtttgtctcaattggctgtttaagtttaatagtaaaagactggttaatgataacaatgcatggtaaaaccttcagagggaaagaatggtttgtggaccatattttttgtatgtggcagttttaagttattagttttcaaaatcagtactttttaatggaaacaacttgaccaaaaatctgtcacagaattttgagaccattaaaacaagcttaatgagaaaaaaaaatgaatgtatttacaagagaagaaaaagatgaagaaaatggtagggtaggacaaattgctttcacacttgaggaaaatgatttctattaatatttgtaaaattgattgacaagaaattctatagtcagagaaggtagatggaaactgtcaaatatatcagtcagaagctataccacatggagagtgttgggtgaaaatagagaagcttggcctctgttagctgaattactcagtagctgaaatgtgtatttaagtatgagtcttttttgttgtttctttataaaatatatttttgaactgtgtgtttgcacacgtgtgtgtgtgtgtgtgtgtgtgtgtgtgtgtgaatatatctctccactgtac

SEQ ID NO: 17430 - DNA, 1116 bp, Mus musculus
cagaggttatggcaggagtggcagctatgacagccataacaacagaggaggcggaggtggctttggtggtggtagtggaagcaattttagagctggtggaagctacaatgattttgacaattacaacaatcagccttcaaatttttgactgatgaagggaggaaactttggaggcaggagctctggcgcttatggttttggaggccagtactttgctaaaccatggaaccaaggtggctatggagattccagcagcagcagtagctatggcagtggcaggatgttctaattacatacagccaggaaacaaagtttagcaggagaggagagccagagaagtgacagggaagctataggttacaacagatttgtgaactccaccaagcacagtggtggcaggacctagctgctacaaagaagacatgttttcggcaatactcatgtgtgtgggcaaaaactccaagaccgtatttatgattaattgtacaacaggttattttagtttctgttctgtggaaagcataaagtattcaaacaaaaggttttactgtagacctttttcacccatgctgttgattgctaaatgtaatagcctgatcatgaccctgaataaatgtgtgtgtgcgttttattgtttttttttaaattagatattttctttattacatttcaaatgctatcccaaaagttccttataccctcccccctgccctgctctcctacccacccactcccacttcttggccctggcattcccctgtactggggcatataaagtttgtaataccaaagggcctctcttcccaatgatggccgactaggccatcttctgctacatatgcagctagagacatgagctatgagggtactggttagttcatattgttgttctacctatagggtagcagacaccttcagttccttgggtactttctctagctcctccatttggggccctgtgctccatcttatagatgactgtgagcatccacttctatatttgccgggcactggcatagcctcacttgagacagctatatcagggtcctttcagtaaaatcttgctcgcatatgcaatagtgtctgtatttggtggctgtttatgggatggatcac

SEQ ID NO: 17431 - DNA, 1632 bp, Mus musculus
aaggaggcttgggaagcaaaaagcattcctggccttctgctttagctggcaagaagaaaggagtgccgccccaaggtgggaagaggaggaagtagcgttctcccctcgggaccagttctgaaaagctgggactgtactaaaagttaacttgggcggtataggtggccgctgccctcagtgacatttgacattaaaaggacgggtttgccttccctcgagtcagtgctggacgagttaatagagacactgactggaaattggtgtattttgagaattatagaaatgatatagccagaaccaggaataagttaaggcctgcctttttatcttgactttggatactgcgttacagtagattggtttcaacatttttgcattatttttataacaaagcttgtgtatttatcaaagcggggagggcgggggaaaattatatctacctgtgatttgcaagtattgtaaatggatgcaggtacctggtgttgcttttaacttttactgtcggtagaggttgcatgtgaagccagtaacctgggcaccaatatggagtgtgcttgagaaaaacaaagtagttacagtggttctaaaaaagaccccttgttttaggaaaactttggccctaactataatattaaaagtatagtgctttttggtgttggttcaggtggtgcatttggccaatggattgctttaagtccagaaatagttgtcattttgtttgtaaccggtggcttttgtttaattggcttgggttttagatattgtcaaaatatctggcattcactatggaaccaaggctgccctggaactcagggccaagtgctgagattataatcgagcagcagatttcatgtttatttctgtcctagatgtttttccctgtttcattgtcttattttgttcttaataaacttatctttgcataattagtatttgcattatttttgtaagttattaatagcaattctagaattgaggaaggggtgttttctttaaagcaagttggtctgtcagttgctagcagttgggaattgggttggaggttactcttagtgtggtttcagttttataaggttacttgtagaaatgcaaggaaagctcaacttgtctcttaactcatggaaacactggattgttagtgactttgggtaaagctctaactaggctcatctttactgaactcttccactggagaagaactataaactcttccagtttatagttctaagtatccatgagaactttatcaaagccaagctgttgacagctaaaagtaacctctagcccaattcccaactgctaacaacaggacttaactttcagagattaatttggggttttggttggtcagtttggggcctttttttttttttttttttttttttaagtttacgaaaaacccagtggggttcttgccattgagacatttcagagtttcctgagaaatgagctaagactgggtcaggtgaccttgcattggaggcagaagttttcctcctggagtccagcagcgaccggattggctgttagtgggggtggagtaggcggcgaacaaggagaactgccatggctgcagctgcacgcgctcgagtcacacacttgctgaggcacctacaaagcacagcgtgagta

SEQ ID NO: 17432 - DNA, 1632 bp, Mus musculus; identical to SEQ ID NO: 17431

SEQ ID NO: 17433 - DNA, 1143 bp, Mus musculus
atgggtcagggaatcttcttgaagttcagttttttcttctatgtacaagggaggtggggaaggaatttctggccgttgccttttaaaatctttaaaaataatttagtcccagccacttgcctttttggaagaagacattcgagaagttttaaaagaagaaactggaacagatatattcctcaaagaggaagatgaacctgcttataaaagctgcaaacaggaggtaaccttgagtattgtgtatgcatttcttttcagagttagttagaggcgggtctttatgtaattttggctgccctcaaacttccaaacgcccgccatcactttctgagaacggtgattgcagatgtgcttcccatcccagctcttccagtattgttgtagtcagtgtttaccatgttggagagacttggctataatgtgaccctgtaaattacttttcttagcactctgcatctgtgaagaaggtcagaaaatcccttgccttagagagctgggacaaagaagaaccagggactcaactgctaactgaagacatttcagacatgcaggtttgtaaagaattcatatatgtttttaaatggctgtcttaagtcataattgttctcatttcatatggattgcttggccagataatttaaaagagagttacagaaaatttagggttattttgcctagttcagagagaatctattatctgtgaagaatatatgatttttttaaacttgttttattttgagaagttagatttttgtatgatatcaaaaagtggaggttcataaagctttaagttttagtattttatgaaattaccaaatattactatagcactagaaatgtatttatgtaattaccaagctattactatagaacttagtgagatgttattatagagccagatgcttcctagtagggcagtgagcagggcttctattaccattcactcagtagtttcttgtctctgtttttgaattagttattttcctctttcttttttctcttagtcagaaaatattcttacaacatctttattaatgataccattattggaaatacatgacaataggtgcaacttgactcctgaaaaacaagatataaattcagccaacaaaacatatacacttaataaaaagagaccaaacc

SEQ ID NO: 17434 - DNA, 1379 bp, Mus musculus
acttgggaagaaatatctaccctagtatgataaaatcagtgtgattcagttagttggtctgagatatggccagttgtgtgctcttgttgataatatgttgccagtattttttaaatcttggccttgtcaagttccacctattatttttaaaatcttacataaaagagaatggcattttgttttagaatatttaaaaataatggtagcagtagttaatttctaattttcagagtatgtcagagtcacaaagagtttatctgtatgaatggttctatagttttgacacagtggtgtgtaagcctgtatatgctaaatgtctctaagcccctatgaaccaaaaatgttttccttttttcttagtgtccttaagattttctttttgtcagcttcacttgagtttggatgcatagtttactccagtagaccattagcatttgcttatattgctttcatgcttatgtagtaaaaacaatgcatattcctgagattggtactgctcttgtattctgttctgtagatttgtatttgtaaatgtgttttcagtccatcttcctttgtttactgaaattaagttgaatttgaatgaacgaatgacaaatgtatgttaatataatctcttagagcattcaaagcccggctatctctgtttgcacatgtaacagatgcagaactgtttgcaattctacaaaattgtatgtcagaaaatacattatcaggtgtttaaaaaaatctcttcctgttcattcgaaaagaatgttgtacttgaactttttctagataagggaggttttttgtttttttctgtgatagtatctttaagtgagtctacatactgaaagtccactttgttgaatgtggaaggaagggagaatctagatgtttttaaagtggagctgagtttaagataatgtacaccaccacacacacctgggttagtgtttatcacatcatactttgaaatattttatctcattcatttatattaaagttccaggaaaatatataactttcatatactaattttgcatgaagtaagatagccaaattcttaacaattagctgtgctttaatgcccccccaacccctccactaaccactattattttggcttagtcagccactgagatactcttctcaattttttttcctggtttaagtacacaaaaactgctcaataagcagaaaatgtactgtgtcaaataaattatataatcaccctgctttaacagatgctcttctgtggcttggtattttaagttaataactggcaggatctcaaagtaggagtatcagaaacaagttttgttttttccagacatggtcttactactatgtagccttggctggcctggagcccactctatagaccaggctggcct

SEQ ID NO: 17435 - DNA, 1273 bp, Mus musculus
attcgccctgggcctggactagacctcgtcgggccggcggaggtctggctatgtgcctttgagggtcgcttgggacgccgagcgagagccgagagcgatgtctcagccgccgccgcctcctccgctgccgccgccgccgcctccccctgaggctccgcagacttcgtcgtctctggcggcggcggcttctccggggggcctttcgaaacgaagggaccgaagaatcctttccgggagttgcccggatcccaagtgccaggcgcgcctcttcttcccggcctcgggttctgtcagcatcgagtgtaccgagtgcggacagcggcacgagcagcaacagctgctgggagtggaggaggtgaccgacccggacgtagtgctgcacaatctgctgcggaacgcgctactcggagtgacgggggctcccaagaagaacacggaactggtaaaggtgatgggcctctccaactaccactgcaaattattgtcgccaatattggcacgctatggaatggacaaacaaacgggccgggccaagcttctccgggacatgaaccaaggcgaactgttcgattgcgcgttacttggtgaccgggccttcctcatcgaaccagagcacgtcaacacagtgggctatggcaaggaccgctccggaagcctcctgtatttgcacgacacgctcgaggatatcaaacgggctaataaaagtcaagaatgcctcatcccagtgcatgtggatggggatggacactgcctagtgcatgctgtgtctagggctctagtaggccgagagctcttctggcatgctctgagggagaatcttaagcagcactttcagcagcacctagcccgatatcaagccctgtttcatgactttattgatgctgccgagtgggaggacattatcaatgaatgtgaccctctgtttgtgccacctgaaggtgtccccttaggcctgaggaatatccacatattcggccttgccaatgtgttacatcgtcccataattcttttagattccctcagcggcatgagaagctctggtgattattcagccacctttctacctggcctcatacctgcagagaaatgcactgggagagatggtcatttgaacaagccaatctgtattgcgtggagtagctctggtagaaaccattatattcccttggtaggcataaagggggctgccctgcccaaactacccatgaatttgttacctaaagcatggggtgtgcctcaggaccttattaaaaagtacatcaagcttgaggag

SEQ ID NO: 17436 - DNA, 1101 bp, Mus musculus
ttcctacttagcagtaaaaaaacaaatctcaccatgataataaaggaggaacagaataataacgtaggggaaatctaaacttgccggggggaaatatgcaaagtcataaagacactttgatgaactacgttaatgaaaaatgaataatggactgagttaatgaaaggaaggtaaggtgaatgattttgtgcttttgatgttttaggctggaccagatgatatcagaaactttgatgccgtcttcactgaagaaacggttccctattcagtgtgtgtgtcttctgactattccatcgtgaatgccagtgttctggaggcagatgatgcatttgttggtttttcttacgcccctccttcggaagacttatttttgtgaacactttgacattcagaaaccaatgaacaacctctagcttgcagaagaaatggaaacacctatttgcgtgaatatattcaactatgtataacagtgcctcatttttatatgtaatagtgaaaactaagaaatacgtattttctgctgtatgcaagaaatagggcatttcaaagagctaagttttgaactgaaatttgtattcttgtttattaagcttatttttaaacaaaaatttgaagctattcttagcattaacctatttttaaaaataactttttgctattgactgttttttttttcctgttaagtttacactaacacatccaaggtagacttttactagtctgttacagttaagataagatgtattactatctttataattctatgacttttttatcatagcagaactatgcaggttggtttatgatggtacaggatggtttatgatgaaaccctatcttcccatgataaatcactatttgcttagtaggattaaaatgcaagggcagatgaagcacactggctgctagtggacgactgcagccactcacctgcagccccagaagacaaggaaaaggcaggcatttgctttgaaatgctcagtccccatccatgcaccatttttttctctagaggaaaagaaaatatttaatggccagaattttttagaattcctaacgaactgagaagtgtaataaaatgctaccagatgtttttttaag

SEQ ID NO: 17437 - DNA, 1200 bp, Mus musculus
aaaaaaaaaaaaaaaaaacctagaagtttttgacaaatttttctaatttgctttacatttctgtgataaacaccaggcccggaagcacttcactgggagaaaggggttatttcagcttacatgttacgctccatcactgagagacaagggtaggagctcagggaggaacctaatccagaaactgacagcagaaccaaaaacgaccactgatatctgacttgctctctgtgtctggctcagctgccttccatgtacatcccaggacccacagagtgacacaggccacaatggctggaccctcccacatcaatcattaatcaagagaatgtttgccagacatgcccacagaccaatctgacggaggcagctcctcagctgaggctccctttcccaggcggctactgtctatgtgaaagggcaatgcccagcacacactcactctgaaaacttaccgcagtctttcttccacttatcaccataactaactttcctgttgttggcttcccttccctttcctgttcctgagacagggttctctgtatccctggctggcctggagctctcactttgtaggtcaggctggccttgaactcagagactcgcctgcctctgcctcctctgctgggtttatgttgttgttcttctcccgatgatggttttgcatgttttgagtattataaataaactgctctgttttaacattttggtgatagggatcaatactaggacttggtatatgctagacaaagcctctacagctgagctacataccctgtaaacactcttgtataacatttgtgtcacttcgatttagaggatttctgtttccggtttgttatttcctcttgtttcatgttttctgggttcagttaagaaatttttgcctacatgaaagttgtgaaaattctttgttttctttctagaaatatactttgggtttttttgtttgtttgtttgtttgttgagtcttttcccagtgtgtccatgttgtggtggagtgcgcatgccacagagcacacacgggggtcagagggcacgttggtggtgttgattgtctctttgtacctttacatgtgttccagggattggacccaagttgctgggcaagtgtccttacccactgagagattagctgtccagctggcccttgagagagtgtctatatggtgttatgtagtgaaagttgatgtttctcctatg

SEQ ID NO: 17438 - DNA, 8327 bp, Mus musculus
tttgggaatatgatacttgttgttatgatctgtgcatgtgccaaagaacccatgagctatatttttgtatgggttcttggctctgactattacagttaaggttgtaaatacaaatactgattctagacaagttagccggaaatgcaggaagctgtagttctttggtaaattttagaacaaatttctatgtttttaataattgtcttttaattctgggacctgaagttattagtttgtatttctctgcctgccttttttaaaaaaaaatatttatttattatatattcactactttgtttatatgccagaagagagcaccagatctcattatagataattatgagccaccatgtgctttctgagaattgaattcagtaccctctggaagaacagatagtgctcttaacctctgagccatttctccagcctgtatttctctgtgttactattttgtgtgtcatgtcaggtccctaacaccatttctgagctgggtgattcttgagaatggctcacagtttttattttgtgtacagtcataaccaaagcctgtgactctgtttatattagttttattgagatagcatcttgctttttgttttatttattttttgccttagccttgcagacacaccaacacacccagcaggcagcaataatttagtgtagttataggacagaaaggacgaccagcaaagggagaaggtgcatggggcagaatcagaggcaaaccagatgagttttgaaacttcagtgatgagacacagaagatacaattcccacagcactaaactgggactcaatgcctaaagtattgaggtctgcttatatatatgccctgtcctagcacaagctaacattcgggcggcttcctataggagaagcaagtgtttctttatagcctgtatgtttgtgcaactagtttaggaacagtgacacactcattaattagttcttagactagtgggaacctcctgaaacatatgttgtaagctgacaatcaagggctgcctgtgtcacagccctttcttagtgtagacattcttaagcctgctgcactagattttctgtacatgtgtattattatattgatgcagtatacctcaatatgaaggacatattagttattaattccagccaattaaagactggaatttgtgtttgtatttacctttgctctaagtagtagaatagattgatgtgttattttaaaagagttttgagcatctgtgcttcagtttaaatagtgctagctttttaagagagttaaattgaagtaaattttcaaatggtgtggagagtactgtgctagatatgggtaaaaactggaagcaattcctgtcttcatggccatgtcatcgtgttattaggactactatatgagcagatttcctccagataagtgtggttgtagtttgtggtgggaccaagtaaggaccatagtaggcaggctcattggtagaatgcgtttgtttcttttacagcggaatgtggccagaattcttaatctgatcagcgactttatgttaatggtgtagtttctcaaccatacttttcatcttcttcagaaggaaaacataatttgttaacagccacataaagaaatgtgacctgaaaatttttgtttatcgtggatgctaataaatgttcatataaaattttatgctggtttctctggcataacaaattatactaaaaaacaaaaaacaaatcagtgtttgccaaatggaaaaaaaaaagatagttgaaaacattttcactgttttaaatgtctgctttttttatggaagaaaataaattctaactttgtttttcttctttatgatcttataagtgaaggttcttcaggcctgttctgtatcagattgttttaaaatattttctgttttgcttcttcattctttcatggggtttactgtgccaatttttaatttaaaaaccttggttttatgtataatgaaataattcccagaatttatgtgtcttaatcaaaaaacaattttgttttgagttctgcctgcaaacttaagtgtgtacagggatgttgtctgctccatgtccagaataagacttggcctgctgacagtgcctgtaattaccatattaaccaattgataaaaatctgtgagtgtgttatcttatatctatagctggagagatggctcagaagttaagagctcttcctgattttccagaggacctgtgttcagttcccagcacccacgttgaatgacctacaacctcttctaatttgagttttagttgatctgacaccttcttctgggctcctcaggcatcagcaaagacatggcttgtgtacacacatgagggtatacacacacacacacacacacacacacacagacataaaaatgaaaataattttttaaaaattaaaaagcattaaattaaaaaattaaatatttaaatgtaatattgaaataaaaagttgtatagaaataatttacaataatttcagttaaaaaacatgtattagggtctggctttatagcattatacagaactttcctagtatattcttatatatgaaaacaacagcaaacttgaatgtaaattcttactatttcttgctagctagcagatcatatttgaagcaaatctaatttgaattaactttaggatgcagtttcagtaaactgatagcacaatcttttgctcaccttaatgctaacacataagactgtagaaccctagagatataaggtccactgtatgtgggccgtgctttataagctaatgtgttttgaaggccgcatgggagcagacgagggtatgtggatggggatgatgtcccagaagagccaaacacacagatctcagctgctgaaaataaaaggtacgtgacagcaatgatctccttgagtcttcacaccctgacacagcacctgcctaagactggcttcaggaaaagtggaaaagtacaccgtgttagcaagccgcctttatagtgagaggaagtagtggggggagaggttgagggcctgggaatgagcacctacggtatttcctttggcattctctctgtctcgctccccctcctgtactatggcttgagcacaaatcattgagtgaggtaagcactttaccactgagctacatccctaggcctataccattattttcaagaataagttttttagtaaagtttggcagggctttcagtgtaaccctctctcattataaaatatataaattcgtttgaaagaatgaaggagaaataacataattgaatggtgttataatgaatttgaaacatctgggaattgtggcttgcagagatgacacagcggttaagaagttatactgttcttgtagaggactcagacttgagttcgagcaatacatctgatggcttaacagctgcccttaattccagtgccagaggagcctaatacctcagcaggcacatacacacatacatacttaaaaggaagtcatggtactgcagttggactgaaaatggattgagaatatccccttagtgtgagtttttaagtttatttttcatttatttttgattattggtggggttttaatgcttacactgtaaaattagtattcaagtttctattgataacaaagcaaataactttctagttttattttggtgcttttttgtgttgtccataagaatgaatagtttaaaaaaaaaaacaaaaacaaacaaaccaaaaacctaaaagaaaacacacgggccgtcaagatgcctctgtaggtgaaggtgcttgtcacagacctaatgagttgatccttggaatccacattatgtgggagagaactgccaaggttgacctctgacctccactctgaccatgccacatgtgtattataaacacaaacaaaaattttaaaattgatgaaatgtaaagcaaacccacatgagctttggggatgtggcttagtggtagactggttgctcacatggacaaagcccaggaattaacccccagcatagtataaacctcacatggtggggcacacctgtgaccccagcactacgggtgggaggggcagaagttcaaagttcgagactttagagggaattgaaggtgaagatggggtacatgagacctctccccccccaaaaaaaagaaaaaaaaaaccaacaaaacctcggatcagggactggatcatgaggatctgcatggggaactgaatatgatggaactacattctgtgcgtggatgaaacatgtacagttggtgtatgctgctcaggaagacggaggaagctgtcctaaaatacagtataaggaaggcggtgtgcagtgtcctgaacagtgcccgttcttagaggaaacaaagtgactatcatccctggctgttagaaaacctgctgtttgtttcaattaggttcccttgacaatcagactcttttctttcaagaaagtttgtttttgaaattctttttaaagattttatttttatcctaaagggataatcttcttttctaaatgggaatatagttaggagtatagtgggggtatttcatataaaaacagatttcaaatctgtggacccagtgaagcaggctgaagaataaggagataaaataccatagttttaactagcatttttgaaagaaaggataattcatattcaccttttcttcttcaagggtacatgtatgtacaggtgtttgtgaaggctgtaggtgaagctctagtgtcttcctccattcggttccactgtattctctgaggtgggactttgccatggctggccagcaaaccctaggggcactgttgtagtcacctccctagctgctgagttagctcttgactgtgtgctgaaggttgaatacaggtcctcatgttttccaagtaatttactcactgagccgtctcaattccttattttttgttcttcaagacatggggtttttacatgtaattgaattttactgtgtagcccaggctggcctcaaccctacaatctttgcttcagccttctaaatgctggcattaatgccatgtaccactattcccagcctttatgttgaattttatttcctaaaaatacgtggattttaatatttgctctctcatattgtttgttttagtgttcactgtaatggaccacccagatctgctgatctcgatatcacaagtccatttgcaggcatgctctttggtatgtccagcactttcagctgattagacctttgtagagtgttgaactaaatgtccttagtgagaactcagggttgtaagtagtgatgacttgtgaagaacagcaggcatttattgaggcttactttatgatggttaccatacaagcatctagtgtgcattgtatagaactgttgataccttaaagcttaatacctaagttagctatggttatagatgatagctgaaaatcagtctgagtaataaattagctatatggttagagatgatagctgaaagtcagtctgagtaataaattagctatgtggttatagatgatagctgaaagtcagcttgagtaataaattagctatatggttatagatgacagctgaaaatcagcttgagtaataaggctgtttattttttaaagctaggattttgttgtattatgactgtttctttttattctgttttatatgtaactcttgattctttgcttatttcttgtattttatttcacttcttttgaacactccattctactactcttgctgccttaatcattattcttgagtgtgtgtgtgtgtgtgtgtgtgtgtgtgtgtgtgtgtgtgtgtgagagagagagagagagagagagagagagagagagagatatgctgagagggatttgagactgtgactgtgaaagacatagacatagagactgacagagagaactgaaaaagaaactgagactctcagagactgagaaagactttgaaggttttaaaagcccacctccagtgacacacttcctctaacaaggctgccctttcctatcctaatccttctaatcctatcaaggagctccatcccagtgactaaacattcaaaatgtatgagccgatgtgcgccatttatattaaagctatcatatttgttctttttctatagtttctgaataagtgggtttttttttcaaaatcatgatgacccaaattttctattttttttaaatcaaagttcaaggttattactgaatatagtccttttggtttgctatatatattatgtttgtcctcatttcatttcagaaatggtatggtgagccttgatttttgcttatagctttgtatacaaaagaagttgttctttgaacaacactttaaaagcttagctaaaatttagttttagtaagatacatgagaaaattgaagccgggcgtggtggcgcacgcctttaatcccagcacttgggaggcagaggcaggcggatttctgagttcgaggccagcctggtctacaaagtgagctccaggacagccaggactatacacagaaaccctgtctcgaaaacccaaaaaaaaaaaaaaaaaaaaaaaaaaaaaaaaattgaatagcatattaggttgatccaacctaaaagcaacctaaaagttaaattttgtctttgagacatagttacctggtacttttagacatttatttcctagaaatgactattgtgagaaagatggctatgctcacaaaaacttagttcttgttgcctgtaaggtttgagcaagtttgtcttttaggtcagaataaagacacatgcttaggctatattttgaatggacgttaaaggggaagtaagtggtaatgtgaaagcaggctgaaaattaattttatcagcaaggttacacctccatccgcagaggagtggacttaggtcaccggtatgcagttaggagctgtgggcaacacgacacagcagtggagtgtttgcagtgaacgagaacgactgacatcattcaaagtgatggctcatcttacatttgaggagctctatccctgaggaggtttgcacagataggggacttatgcctctccaaaggcggtggattttgtttcatgttactccaactccacttgtactaaaatttattttcctattgtttagcttcagaaatttcatttgggacttttacttaatcaaaaaacaaaataaaactaaggtgaacatggtagtacatacctttcatcgcaacacttggagttgaggtagaggcaagcagatttctgtgcatctggggccatcctggtctacatagtgagtgccaggacagccaaggctacatagaccagtgggttctcaatctgtccatctcaaccctcacaggggttgcatatcagattcctggttatctgatatttatttgcataatggttcataacggtatcagaattgtagttatgaagtagcagtgaaatacttttgtagttgggggtcatcacaacataaggaactctattaatgagtcacagcattaggaaggttaaaaaaccactgatacacactctttcttagcagggaggagttagggggagcacatgagcaagtttggagggaaataacaatgtgctatggcatttagaagagagcacagattacttagacgtatatatttaaattcatacaattgaaagctttccttcagttttgtatttttgttgctgcctgtttgtatctcagtcctagggattgagtggagcactgttatgcctaccagctaagagttgtaccacagagctacattcttaatgcatgtcggtgtctcttatagtctgggagcacaattcacaaaatattatttcaaatttgtggggcttatgaaaaggttttaaaagctttttatttacgtccctggttcagaatatttgagacagaatcttgttgagtgacccaagttggactagaacttgctttgtggttcaggctgactgagttcacaaccctgtctgccttctaagtgccgaaattacatgcgtgtgcttctttcctccttttcctttgttttctgaggcactgtttcaaagaattgctatagaccaggttggtcatcaacttgagatctactgagattgcatgcatgagccaccatgcctatgtaaataatcttttttttttttttttttttttttttaattttcgagacagggtttctctgtatagccttggctgtcctggaactcactttgtagaccaggctggcctcgaactcagaaatccacctgcctctgcctcccgagtgctgggattaaaggcgtgcaccaccatgcccggcttgtaaataatctttttaatggcttagaaaatacagtgtgtattttaaagattgtttatggtctggttttcagtcataatggtttgtaactcagttaaatcaggctgc

SEQ ID NO: 17439 - DNA, 1253 bp, Mus musculus
cttgtaatcttgtgaagagatgcagagttgtaatgggctggcttgtaggtgccctgtgtatgtcacctgctacccgacttgtatcttttgccttctgtagatgatgagggttcactggttgatcctgatgacatcatgagacacctgagtgatgatggacgcaactctgcggcaactgagccctggctccgccctggcacttcagaaagtctgaaacggttcatggcagagcatctgaatgaagaacagcataaggggcctgggaagccaggcacgtttacttggcagggcctctctgctgcacatgcttaaaataaaccctctcggatccagtagtgccttttacagtggaacgttcacctgtatcttgaatactatgtcttgcttgtggccctactttaatattagttatttatgtaaagtgtatttttcccatgatgatacgttatgtatatataatgtacataaaagccctgattattggtttctaattgtatagaattatttttgcaattttgctatgggtggtaatgaactcttgattgagctaccgtatgtgcattaaaatgtgcttgccattaagaggtggtgagctagagtgtacacagcactgtgaaacaatacactgttactagcctacttgccactgttagcattgtggagaaacaattcagagagacttgttttatatacttgctgttgctgtgactatgccagctgctaggcaatgaaagattcaaacaagctgctcattttcatatctgtagttacacattccataggagcaaagggatttgtgatcatccatgagccatgattaaatgttacatttttctgcctccatcttatttttatgctgatagaagcacagactgggttactaatttatctgatttcactatttcttaacacaaataaagttctatttttattaactaccagtgtcggtttctttctttactcaaagtgtttctaggggttaaaaaggtcccatccagagaggatagaggcagtggtcttctgtcccaccacctgagacccttggctacgtgaactgataagtaaatgatattttacttcataaagactcattcaacttttagaaattctagaaaataattcttacttggattagggtcttcagtgtgtaccatgatggcagttgaagacaggcagccactgcttctctgtaatttccagggataacatcaacatccaattttgacattagagtttaccaaaaataagacatt

SEQ ID NO: 17440 - DNA, 1741 bp, Mus musculus
gtatttcaaatatcacaaccacctgaacaggaacttgggataaacaggcaatgatgagagccgatgtttttctgttggtgtttacattgctctgctctgtgaaaggatcctgcagcagaggcttcctacctgaaaaatgtttctctcaattgtagtgtgtgagttactggtaagacgcttacacctataactcaaggtcggaatagtccctccagtccctttagtaacccagtggcctctgtctcgtgttgggctcatgttgagcagaaaggctgttcccacagcatcagcctacctttagggtccttccctgtcctctaagcagggtgagcccacactgtggcaggtacggaaattacccaaagaagtatagatgtaaagactgagcttctgcgagaagtacaactcaggagagctgtattttgaaggataaaatgtttataattgggggtgggggaagggagaaaaaaattattgctcatggtaaaagatatttagcaactatggtattcttactctgaagatttttgcacactcaggctatctgagacaccggaaatcatcatctttctgtgaaaatgtacagagatgcaggtctgtaatataaaaatcttaaacatattgttcctcctgcactgttttatttctttattttcttatctacttgctaaatacccataatattttgtcaaatgcactaaaacatttgggttgaacttttagtctttgggggagtggtggtcattttgagggcttgctgtgccctgaatctgttgtggctgatgcctgtcaagatgacaacaggaggggatccaccaaggtagaaaacatccctgctgacaagacctacctgtgacatactcactctcttagggcttttaaagacaagccattaaaatagatgacctttcacagactgaaacttgaatcactgcaaaatgaatctaggttgctgtcactttttcttttgggtggcggggcttgatgtagattttattctatgtacagaatttaatgttgaatatattaaaaataacaaacctggcatggttttgggaggttagatttactggaaatgtattcatactgtgaactgtgctctgatggttagaatgaaaagcttatcaagcattccatataacagtggatgtagaaaatgttttcaggtggatatgtatatggtacagatgtaaagttttctatgtaaaaaattctgtacaactttctgtacaatattgattctcatctggcatatctaatcaggttataggtcaataaagtttttgaattatttcatcagtgcagtgtaacccacagccctgttttcattgttttttgtttgttttaattaaaggtcaaaccatgaaaagattttttttaagctacagagacccttcttcacagtctacattggattcttcaacttcctttcttaatcttaagatacccaaaagcatatttattactcagtgataatgctggtagtttatactatggcattttatagatcagtcagttccgtggtacatagcattaaaaatcaaaactgcagtggttaatttcaaaacaggaaatatgtccctaaataatgagaagttagtatttatgacaaggccaggttaaatgctagaactaagttacttcagtgttttctggtctaagccatttcctcccatggctgaagaggacacaattgttattttcaaatgttgacagaagaaaacttattatcagagcaaaa

SEQ ID NO: 17441 - DNA, 1179 bp, Mus musculus
taatctgcaggaaatagcatgagctgagcccaggaatctttaggctatgtaatggtagcaggaaagacacatccgcaatgagaagcagtcctgggacaaagtctcatgcaaaagagcaggccttcaccaggaaacgctcttgtttgccatagccttttctgtctgttttctatggtaaattagtaatttgactaggaagtgggagctggagagacagctcaaaggttaagaatatttgctgttcttggcagaagacccagtttcatttctagcaccctgtctggcagttcatagcttcctatatctctggttccaagggaattaacaatcctatagcctgtgtgggtacctgcatacacatggttcacatacaaacgagcaggcataaacatgtatatgtaaatattagagagagcagaattgggagggatcgttgagtcttcagtttactaaaactggttaaatgtatgttatggctgtttgttttccaaagagagatgcagtagacttcgatgttcgagttgatactcaagaccaaggaatgtaccgctttttaacatcacaacaactgttcaagctactggactgcttattagagtcgcatagatttgcaaaagcatttaattccaacaatgaacagaggactgctctgtggaaagcaggtaagctgtccaggtctcatgctgtcactgagaacacactgatgtatgtgattgtcaaaattccctgagtgagcactttaggtctagtgaaaaaaggcaggcaggctctctgagtttgaagtcagtcaggggtacacacagaaacccagtctcaaagccctccccctccccctccccctcccccccacaaaaaggaagaaaaaagaaaagaaatagatgtcagtgcctactcatagaagagagtcctcagagcacagccaggaaaatcaaggggctgttgtctagtatcaccttctgtacccactacagtgctggccgtctttgttcatcctctccccttggtgacccaacgtagagaagaactgaacggcacttgccttttcccctccccttattgctaccctctgactaggacatccctgtgagggcctgggttcctctgccctttaatgtttctggcttgcattatggagccctgccataggcagagcactgcagctgcgttctgcctgaagag

SEQ ID NO: 17442 - DNA, 1236 bp, Mus musculus
cttgaagcgtctgtgtgtttaaaaaatacttacctagatcactaaaacccataacaacaataatatggctcaataacatagagtgcttgattgtttaagagtattaccataggactagagagattcttagtgtttaagagcaaaaactgaggttgcagaggccccagtttatttctcggcgctcacatggtggctcacaatcttctgtagctccagggaatccagctccctttgtggtctctgttggcatctgcactaatgaacacacacacacacaaacacactctcacacacacacacgcagacacacaattaaaaataaatcttgaagaaaatgttttcatacttaatcctttcaaaaaatataaatatacataaaacccctatttcaaaagctcattaaggttttccctcccactgctattacagctcaagtcagactaccatgtaagtctgtttgacttgtgtccagcttcccttcatgacagcaaactcctgtttagtcccctcatactgacctttctggtccttgatgccttgtgtaacagaggatactttcctaactcctcccacaaaggaaagtcatgtcagctacatgaactctccctccactctaacacatgtgcgttgtgtcagatctggagaacacttgtgaagagtgctgctttctcattcattgcaacatcacattcctatccatagcacatgaaggctatcaagcctgacaccacaaaggctcagaaagggtggtttggcttggtttggtttggtttggtttggttttttgagacaggctatcctggaactctctgcttcttgtgtgataggatcaaaggcgagcgctgccacacccagcctgggtttaggttttgtgcactgagtttcacactctctgtagtccaggctggtctcacatttgcagcagtccttttgcatgaacctcagtcatgtcctgaagacacttatctttatctatgtctagacaattttaaatagaggaaatcttttttatggataatgtgtaaattttatacttttaaaaaactagtataatggaaagcatgtttgtccctgtgatgtgcttatctgatgaatttatcttattaggatgcaatatcacaaaaatctgtagacatacatgattctattcaaccaagatcttcagataacagacagcaagcaccactggtttctgtttctactgtgagtgaagaagttagcaaagtgaaatccaca

SEQ ID NO: 17443 - DNA, 1159 bp, Mus musculus
agatatggaccagggtctgctgagtataaaataagtactctcttccaaatgtgtagtgaatagtttattgaatattttaacatactgtccaactaggaatcaattattgctttattaatgtaagtaaatagacaggctgagtgatatttggaaatcaggcaatgaaaaatgtagggtaacttattgtaagtaggaaaataattcaggggattatattgaaactaaagaatctggattattgtaaaagtcagtgcttgtaaagagaaattaattttaaaccaatgataagactttatacatggatgttgactatgtctgtgttttcttttttgtggatagtttatagatactgttattaagatacacctaacgtcgttactgagtgtattattgtttccatttatttaagcccagaaacgtaattttcttttttctttacgaaaactttctcacttattatgccaagatgttcaattatcacttgatgcatatgttattttaaatttttaattcttctagttggcttggacaccttttctggctgcattcagtgtgggtctccaagactgtgatgatactgaagtagcctctctttgcctagaagggataagatgtgctatcaggattgcatgcattttcagcattcaggtaacaaagaattttaccttaatagccagttttgaaaatatacaccatcaatatagttcaactcatatcatttttctctgactttcttaaaaaccagcttcaaatttatgataagtttaaataatttttaagagactgtgatagagcaattctgtatgatgtttctaaacattgtaagtatttattttagatgcctcttaaacgtcagaactagttatctttaaaagaaccaagtacctaacatactctccatgaagacagtccttttagagagtttatgaagtttaagcatgacctttagctagactcttctatttcttaacccattttatatttcattgagaatgttatgacttagtgtattacaaaatacagcctagctatagaggaaataatgaacaaatttataaataaaggttttgctaatataattaaaacaaaattttcagtaaacttattttcactgtataaattcatttattgactactgaaaatctcatttggaattgtc

SEQ ID NO: 17444 - DNA, 1109 bp, Mus musculus
gtattaacatctaatgccttctttcccagcaaaattggtagtagtgtatagatgattctgggatttttttttccttttttgcagccactatttacaaactgaatgtcataaaaaatgatgacaaaatttggaaagagatttgatgtcatttgaaagtgttaagatagtccctccaaaacactatcagtaaaacctggtttagattgaaagcagcaagcaattctaatttatcacagtgttcttaaggcctggctttctagaagtattactattagttttgttattggtttggttttttttggttattgcaactacaaatagttttccaaatttagtaaactacaggaaaaaatagactttagctttgattatacctcactgtttttgtttaaaaattagtatatattcattcacatatatttcaactcatagtccgctagtatatttattagttatctcttatgtctgtttcagaaacttattgcttatgggcacttgactggcagggctccagatagtacgacaccaggcaaaaaattaattgatagaattattgaaacaatatgtggctgcttccaaggtcctcaaacagatgaaggagttcagttgcagataataaaggtaatgaattatataaggtgtattatttattatacttttgaatccagaagcatctcgacctgaaaacatcaggaagagttgttctctgtgcactttgggtgtgacgggcacttgggataatgtttagaacccatatgagatttgttgttttatgccattaggagaaaactgtgtttctctatctcttctcttggccatccagttaggattgaattctttgggtcttgaggagtttttctgaacctacctgctttttatacatctttcatcttttaagtttcaagatgattcataaagttgtgaccttaccaacgtttactgtattgttagagcctacgttgtccttctcaggccttgtatcaatcaccaggtgtactgtctttcacaactctcttgtacccatccatctagtgaacctgctcaaacaaagtgaacaaataaaatccaagcttgtgttgtaatgaatctggatggttaaattcgtttag

SEQ ID NO: 17445 - DNA, 1451 bp, Mus musculus
attcattatcatggccatctctcctgcccctccccacatctgatcctgaacccacccccaattcccctccccattccttctcccacccagttcccttcctccatctgcctttttatgactattttattccctcttctaagtgagattcaagaattctaacttgtctcttcttcttccttccttctttcttcctcctcctcctcctcctcctcctcctcctcccccttcttttcttcttcttctggaaaacaccaaatatcggatgacagcaatgcagcaggagggcctggaggacccaggggcccaggattaggaggccccggtggcttccacggaggattctgcagcggtcttaggagctgtggttgtggccaaggccgtggctgtggtcgaggccgaggagctcgtggaggtaaagctgaagacaaggagtggatccctgtcactaagctgggccatctgtttaaggacatgaagatcaagtccttggaggagatctacctgttctccctgcccattaaggagtttgaggtcattgacttcttcctgggtgtgtccctaaaggatgaggttctgaaaatcatgccagtgcagaagcagacttgggctggccagcggaccaggttcaaggctttcgtcgctattggggactacaatggtcatgtttgtcttggtgttaagtgctccaaggaggttgctctgtgctggtgtgtctcatccctgcccccagaggcactggcattgtctctgctcctgtgcccaagaaactcctgatgatggccggtataggtgactgctacactttagccagaggctgcactgccaccctgcgcaactttgctaaggccacctttgatgccatctccaagacttacagctagctacctgacccccgacctctgaaaagagactgtcttcaccaagtctccttatcaggaattcactgatcatcttgtgaaaacccataccagagtctctgttcagaggacccaggctccagctgtggctactacataaggattttatacaagaaaaataaaaggattaagtctgcaaaagaaaaaaaagagaattctagcttataccttcattctatttattgcctgcatctcttaaatatgaggttagctgtggtctggagatgatattctatatagcataatgttgggtgatgaaaagtcagcttagtgattacaagcacttccaaaggtcatgagttcaattccagcacccacatggccctcacaaccatctgaaactccagttacaggaaattcaacatactcttatggcttccaggggcactgtacacatatgatgcacataaatatatgcagtcaaacacccagacatataaaattataaattgaaaaatattaaagggaaaggtgttacttatttgtatttatttcaacagttacagttggtctcatcccaggccacaatggcaa

SEQ ID NO: 17446 - DNA, 1107 bp, Mus musculus
cagtggctacattgatagcccagctgaactaaaatcttttcaagtctcttgcaggcaattttgttgtgatgctatttacaacttgtgcaatgaaaaataagtcagtgtaaaatgattaggaaagttgttgacaaaaaaactctccttgtgtctgtgtttccagtgaagagggagccatgctttatcaggaaagtacagacatgactcaggaatagaaaatgaagtcaagagttttctttctttagcttctttcagcgggtttaatgagcattattgattaaaccgttagggtcaacagattttaaattggagtagaggacggacaccttgctgagaaccaaaaggttatagctgttgaggaggcaggcaattaaatgaaattgattttctttttacatgaaccattagatacagtgcttgaccttcggtggcctacagttacatgtgaaacaatgtgtagaacaatttgaatcaagtcagatgctaaatccttgtgaacatcatgcccaactagacgttaagtatgtaacttggaaccattagcgtgtgaagaattcagaggaattctcagtaatgattctgaggaggtcacttctccagttgcttattgggaagtggaaataaaaatttttattataaatatgattattcaattttctatggaaaagatgtcttttatacatagttcacaatgtcaagctaattttaattttaaattctctatcatatatccccgatcatgtggccccgtggcctatttttttttactgttaattcttatcaaactattattattatcatcattattattaatcttttttatagtccagttgttatccccctctgggtcctccctctgacagttcttcatcccccacccatatccaagaggatgtccccacccctatcccaccagaccttcccactccctggggcctcaagtctctccagggttaaatgcttcttctctcactgaggccagtcctctactatatatgtgtcagggcccctcctatcagctggtgtatgctgcctggatggtggctcagtgtctgagagatcttgggggtccaggttagttgagactgctggtcttcctacggtgtt

SEQ ID NO: 17447 - DNA, 1175 bp, Mus musculus
gaagctgctgcaagtttaaattattatgaacatttggtggtggtaaaaataaaagtaaataaaataataattctatataattttattaccactgagtatagattcacttatcaaatgttccctgcaacttaaatctataattacatcatgtgtatatagacagtttcagaaatgcagaatgaaaacacaaattaacagctttatcttggtcccaatgttattcttttctttatgatttggagatgcatgatttgaaaaaatgaactatagcatgcacatttttataatcctctcttatagtgaagcatgagttccaaaatcatgacctgcccttccttaatggctcatctttagatactacagcatattcaatcataacagtgacatactttatgctgttgtattttttgttatgtatttgtgtatttctagcgtttctcttcttttcaattctgttaaaatgtgtagactgtaagatttaccacactgagtgtggaatgaagcattaagtgtgtgtgctctgtcagcattcactaggatgtttttatcttacaaaattaaatctcaatgccaattaaacagcctcactgcctcccgctctggactctctacaagcttccatgcttctgctgatagatttttctagatcatgcccaggaactcatctaggcaattattccaaatgaagctcacagagtatttttcataggcttttctaaagtgttataattttaggttttgcatttatgtgtatgatcctcttaaataaaaccttctatgtcgttgatagatgtgctttgaagtatatgataaaaatctgtttctaattgacttatttgtatatccttatggtcttcattataataatttgatacatatagtaaatatagtaattactaaattagggtaatcaatttttcatcagcctgtgctcagaaacattgtacctttttttttctaattacatggaaatttatcaattgttgtagaccatagcatctttctgtgtcacagaaccctgaagggaacattcattctttttatttctgtatgaccatttgttccattaccatgttcaattgaatgccttttaaatctttgtagaaaataagtcatccatatgctggatatatttctggactttcatgtctgttcctttggtttcattgtctcta

SEQ ID NO: 17448 - DNA, 1287 bp, Mus musculus
gactcagtttgtgttttttcacgagatgaagatggagcgcggtggctgccagagagattaattcgtcagatgaacacagattctgactcttctggtaagtatcattctaaagactaaaattccttttgtgcttaaaattcagctgagagcaacagctctcaaaggtgttctccagctactctctgaaccagctcccgacaggaggccggagactagcctcagctttacaatttgcatttgaataaagtacctagacttcccggaaagaagttctgctttcctactttctcactgtctttcaagattttgtctttcaagcaggtaaatcaacattcccgaggcggaccagtggatgtgcatccccgcccccctagagcacacaagtgacagctgttacccccagtctcaggacatttccagcatgtggctttcagtctgagttaaaaatttaggtttacctagagggctagaagagtagatttttctatattaataaagattggtttttattttgatagacaggcttagccccttagctgacctctggcttttcacccttgctgttactgcaaggtgtccttagctcaataggctgtggaaaaaacagggatgaggaggagcgacttccagctcctattttacccacaaatcgtggtgttattaacgacataattcttgctcaggctttgctaattctgaggttgataattctcctttaggagctgcacagcactcagaactgtgcatactggtttgtgattgtacaaattcagtatgggcaccgcttggtgcagagatacttactgcaagggaaggtccggcttgaccgtttctgagtttcctgtgagataaacccggtttaaaagaggttggtatcatattttggttaaaaataaaaaatattctccggctctacctcgcctccccaaaaggtaccaagagccacatgtgtgggttttacccacgggaggaatcgggtccatgtccacccaagccaaggttaaaagcccactcatctacggatgagaaaatcatttgatcacctcagttaagcgttgccttatttaacttaattaataggggggagagagattggagacgtactattgaaagggcaagcccttcactgcctcccacccaaataaaaaagccaattggccttgtactacaagagccggtcactccttctccctgtttcccacctatcttccaaaaatgcggaggaatatcaacttagtgctattttcacatctttcagtcaaacttagccagagttccaaacgccct

SEQ ID NO: 17449 - DNA, 1114 bp, Mus musculus
aagcaacttaagtgctggcaaagcccagagccaaattattaaacttgctctccataaagaatgcatcattcataaaatattcagctcggggatgtggcatgtggcttttagatgtcacctctctccagccctgtagagcaacagagtgaggtgcatgctctgaacaggtagaactactgttgctaacggaaggccgtgggaataaagttctgttggaggtaattgtataatttgcattggtaaagccatgactgtatctcctcatatcatgagaaatggaaaattattattactcaatactgttttgtgaaagaaaacttagaaatctacaaggatgcctaaggttgaatgctctaagcattgtgattaatccactaagctgtcatttgcagcactagacagacttgtgtcctgtataacagagttgtgcgtatgtgagtagctctctctctctctctctctcactctctctgtgtgtgtgtgtgtgtgtgtgtgtgtgagtagctctctctctctctctctctctctctctctctctctctctctcttttatgtgcaaaatggaccaaatagaaagattccttgtcaagttttaaagatttcctttaagtcagatgtggtggaatgcctgcaatttcagcattcagaaacctgagccaggaggatcgtgagttcaggaccagctgaagatacatggaagagcttgtcacaggaaaaaaaaaatgcaaaaacgaataagtcaattatttcaattaaatttaaaattcttatttaaattatatttctacttcaaattatctgtgactatcaagaaattgtaagatacaattgaagctgagccctagttctcttacctctacattgggatgaaatccatcaacattctatgtcaggcagggtctacaaagaccagccctgtcatgtcaaccttagcctcagttacagcagaggggacacaggcagataagattcaagtcggagtttgtgtcactgtcacctgaggaccagcagtaagataaggcagcagcaagacctctaggaaatgagccaaaactccacatccccaggggatgagtgttggaaggacgaaaggaagtgcacagaaaagtatcta

SEQ ID NO: 17450 - DNA, 1192 bp, Mus musculus
ccaggccactgtttgtacagctgcttgggaaatggagatgctatctgagtcactgatcagtagttctgtgtgttacccactgccttttgcagaagaaagggaaaaaatccacgttccaaggcattactttagatcaaaagcctgttttgaaacccttaactgatgctgcctttgtattttttcctctctcctttctaggactccatctgcagatgttctgaaaacctctgagtctagaaattgattattcacccaggatacctaattcaaggtattagctcttgtcagaaagcttttacatctcagctcggtcctgcaaattacactttggcaatagctgggaacgggaaagttggatggagaataaaggataaaagtgattttgtaaaataatcaagtatttaaaatctccctggtggtagtgagggtctgctacctgtgactcacacacagctcagtcccgccagcctgcctgccagctctggcttatttgcgggcccttttgctacaaccgtgtttcggtttggatttaattctcacccttttccctatttctcttgatacctcccccatcccctacaccccagctcccagaactcagccgaccaaggagcttggaagactttgcaactttggaccaagcacaatgaagtattccctctgggctctgctgcttgccgtgctgggcacacagctgctgggaagcctgtgttccaccgttcggtcccagaggttccgaggaaggatacagcaggaacgaaaaaacatcagacccaatattatccttgtgctcactgacgaccaggatgtggagctgggtgagaatctgactttttgatttgccagtctatttgattcgaatgctttccagagcctcgcctgtatcagtggtaccagtggtcctttagaggaccagtgctttgctagctgctcctaacaaccatctggttaacaaaccgaactcgtacggctcataaactatttgatttgtttcagtattacttctctggtattatatccgtcctgttacagcattaaagaataatttcaaacaggagaagaagatgggaagcttgggaatccacagaggtcgtggactttataaactttatgaaccctggaccaagggaattgtggctcattcctgtagtctcataacttggaaagtagagatgagagatcagcagtttaa

SEQ ID NO: 17451 - DNA, 1115 bp, Mus musculus
atgtttggatcccaaatggcttgttttgttctagaattgagaactgatagaattgtagactccttcacacggggaagggaactaataaatgagggaacagcgctatctaaatgacttatggaagtgtgtgttttgctaaccagtgtcagacctgtgcctttcaggttccctgcaagtcatgaacaagacgagaaagatcatggaacagggtggggccaccttcaccaatgcctttgtgaccacgcccatgtgctgtccatcacgctcatccatgctcactgggaagtacgtgcataaccacaatgtctacaccaacaatgagaactgctcgtctccctcgtggcaggcaatgcacgagcctcggacctttgctgtgtatctcaacaacaccggctacagaacaggtaaaacatgacgttcctttccccccacagtctcagatgaggggaactgcactgggtaatattatatatgagaagttccaggagactcaacaatgaagagtctaacttctctcgtctctgccttggtccatgttctgttgctataacagaatccacgaggcagggtaacttactgaagaaaaaggtttaaggagcatagagtcagtgggtcaaagttgcaagaacatgctagcagcttccagcagaagattttattctcaatcattaatggcaacgagtgaaaaaaaacaagttaagtgccctgggaacacaaggctggcctcacttcctagtaaccttgtcaggaggcaaaaactactcctgggaaaggtacttagcgacctacttaggtctaaaacactcaaattttaaagaagataagccatattaacaccagagcaaaaagtgttttcactcaggaggatgtaccaatgtgacatcccttatagaaaacccaggacttgggctggagagaccactcagtggttaagagcactggctgctcttccagaggtcctgagttcaattcccagcaaccacataaccatcagtaatgggatctgatgccctcttctggtgtgtctgaagacagtaagtgatagtgtactcacatacataaaatgaataagtattttgaaaagaaaagaaaatcctggattctcagtgggtgcc

SEQ ID NO: 17452 - DNA, 1828 bp, Mus musculus
tctcactaatctagggtccccttttctaaatttcatctaagcccagtgttgtactgtcagaaagaaagctggtgtgctctgtgcacatgtaaaacctgctcacacagtggcttccaggagcatgcatccatgcaggaccatgcatatgaagaaacatccctgagcagctcacttgcagcacttaagatttggttttgtactgagtaccaagaaatacaaaataaagatactccgctgagaatttgcctattatattaaaatattgtgcagtctatctgttacctggaacctgatccgtataaatggctttgtcctgtgactgactgttctcacactgaggagctgagcaagcccagtgagcacgctgtccctgcacgaggcagaagctgtccctgcacaaggcagaacagtgccactcctgtttccacatcacactatgctctgtgtagtcaaaggtggtcttgactttctcattctcctgcctcaatccactgagtgtgtagcaggtgtgtagctggctttacgtgctctaggcatgaaacccaggcttttgtgcatgctgtgcaacacttcaccaactgaccccagtctcccctttctcttattttcattgtccttctgtcacctttgtatacaaacatcactcaacattcaaatactaggagagaatactttccattattacatttcaaattaatttatagaatatttacatggctcatccggttgagtcaaaaatgttttgttacactaacgaggtctcttggtttctcttctcacagaggacagttatgggatggatgggaaggttagtcagtccaatattacttcagacaccagctggcaaggcctggaggagttatccggtgcaagcaacatcgatgagtacaggtctaaccctagactaagtctggaggactggactaactacctgagggctgtctacagagcctttgcactgctgaacagtcaccctgatccaaacaaagcaaatgggactccaaccacacaaggtggtgacttcctggtcacctctgctgagcgcttggtgccagcagagatggcttctgcagaatcaggtgaagacccaagtcatgtggttggggaaacacctcctttgaccttgccagtcaacctccaaaccctgcatctgaacagaccaacgttaagtccagagagaaaacttgaatgggataatgacattccagaagtgaatcatttgaattctgaacactggagaaaaactgagaagcagataggatgggaggagctgcatcatcctgaaggtgacgtcgtcagtggcaatggtatgacagagctgctgccccagtctcatcttgggcatcagctcaccagtcagcaccaacaaaaatgttcccaggatgtggagacagagaaggatgcttttgaagatcaattgcgtcctcttgtccactctgacagaactccggttcatcgggtgttcgatgtgtcccgtgtggagcagcctcttcactccagccacacggagagaatgttggccaagatggggcagagtgatacaaaggagtggctaccaaatctcgaaggcagtgcctccgctccagtcatctctgcttagattagatgttgcctaacataatatttctttccatgttttgattagtaaactagtggtggcaatcatgactgccaacattctgagcccccacctccacccccctccctgggcacactcatgtgcacagcagacactcatgtgcacgtgtgtgggcaatgctcacacagactcattgtaacttgctattctaccaagaagggagaggtgggggcacattttctgttttga

SEQ ID NO: 17453 - DNA, 1135 bp, Mus musculus
acagagagctcgtccccagggtcccgcagcaccttcaggcaagtacaattaggcaaagacctcggaaaacccctggagggtttcaaaacttaccccctccctcagactccaacctgctaatctaatgctaatctttgctcagaaactacaggtattttaacaccaactaattaggtttgctagttctccgggcgtaggccgggtctttcctaaagcttgatgtgtgtgttattagctaagtgggtctatatactcccgaaagctcgcctgacccttttccatgacacagaagtcaatgaatggattgataagaccacaaaggagacagggggcatttgtgcgcagtgatttctcctttaaagaaatgattaactgacagagtctattgaatgccaaaatctaacatcagattttattcttaaaccaatgcagtttaatacagtggttataagataaacatttttattagtccacagagaattcctggggaaacttggcataagctcaagattcaaacaaagatcatgattctcaattaatttctgtgtctctgagtctgtctgtctgtctcccccctccttacctcttctttgctccatctttcctgcttctcttcttctctctccatctatctgcttaggcatgtaagtgccctctacctcaggccttttaatgtctgtgtttggagaagttcagttcttgtgcactctacaaaattcctgcatcctaatcaatgatgctcctgcttcctttactcctcgtcccctccctccctcccttcctttctttctttcaattttttttaaatagtcacatttatattttattgtttatattttattgaacactataaatatagagaaacgctaacatatgtaggaggatgtaaattagtagcatgcaaacatgccacttcatataaaggcttgagttgccaaggattttagcagccaaccagctttaggggtagcttcagagatcccccatgagccgggcagtggtggtgcacgcctttaatcccagcacttgggaggcagagacaggcagatttctgagttcgaggccagcctggtctacaaagtgagttccaggacagccaagactatacagagaaaccctgtctcgaaaaaccaaa

SEQ ID NO: 17454 - DNA, 1234 bp, Mus musculus
gaaaagacccaggcacagtgaagcttggctgccatgtcaccttgttgcttttgttttttgagacaggattttttttttttcatataaccctgactgtcttggaactcactctgtaaattaggcttagccttgaactcacagaggtccacatgcctctgcctcccaagtgttgggcttaaaagtgtgtaccacagatgtctgtcaaaattagagtttctcaatcaaaacaataaaagctgatgtgtccattacaatgaaaattaacccctttgctgagttgcagcccatggaagttggctttttctgctttctgccctctgcagaagttcactgcctccagcatactccgaacacacatcagacagcactcaggagagaagcccttcaagtgcaagcattgtggtaaagcctttgcatctcatgctgcccacgacagccacgtccggcgctcacacaaggacaatggccgtagctcctgcgatatttgtgggaaaggcttcctggatcaagaggctttctatgcccacatgaggcttcataaaacctgctaggtctttgaaagcaaagccagttacaaaccaagaacgctgactctcattcctgctttgtctgtgtcgcgtgggcatggttgaagtgttcagtgagaatctggagaatggagtagttgatctgaagctccaaaccttatggaatccattcagaccaggagtgagaataaagtcctgggtcttgtgattaaagaagaaaaggttccccctctcctgtctgccttgaacaccccgttatacggtgtctgtagccagcgactatgtgcatgagtgttcgccgcgggcatgtttctgtgctgcatgcgtgtggaggcccaaggaagacatcagatcctctggggctgtatttacggatagttgtaagccactgtgtgggtaccgggaattgaacccaggtcctctgctagtgctgctaggacttaactgctaaaccatctcaccagctcctgctttctatttggttttggtggtggtgttttggtctctctctctttctctcccacccccaagctggctttaaatttgtcctatagctgaaaatgaccttgaattacaggattaagttaccacagccaagcaatttgcactacctagagatttggtatgttataactaagtcttctgccgtgtattagtgttccatcttaatttgagctcatttctctcctcactgagcaatgaaaatg

SEQ ID NO: 17455 - DNA, 1193 bp, Mus musculus
cagaccgtaaggtctctggttctagtatccaggaacatcttgagtggggacgttcttttacctgtcccgaatatagtcacacatcttgttgacttggggtccgagctgtcttcttgagctatggatttgttataccttgtctgacctgtaaacctgaccctcctgcctctgtcttttcagtagtgggattactcttggcacagacacctggatctgacacctctttgtctctagtttctctcttccttctttgtccgttggaaaaaaaaaaaaccagacttacctttctgtgcttgctttctgacactcagtgacttatcactcctgggtcagagtcagtaagtgttagaatcaacgtctgtgaattactgaaggcacgatgcattcagtatatgtagtccaggctgacctcaaatcccctttggagccaaagatggccttgcactcctgatttttctgcccaggttcacaggtgtgttccaccacacccggttatggtgtgtgtctgtctatagctgttttgaatcctctttgaggtggggaagaggagggacagaggttaacacaccttccgacacttccacccctgtgtttgacagagtctgcagaaggttacagatgtgaacgctgtggaaaggtgtttacctacaaatactacagagataagcacctgaagtacacgccctgtgtggacaagggggacaggaagtttccgtgttctctctgccaaagatcctttgaaaagcgcgaccgcctccggatccatattcttcacgtccatgagaggcaccggccctacctggtgagcagttgctggtttgatgtcttcctagtgtgtttttacactcccttgtcgtgaacacacagagaggggttcatgggactgactagaacattcaatgcttgccgtgccggggtagtgtggaagacgccaatgtgtgagcgtgagcgaatgtgcccaggaagaagcagggaacagacgtaggagtgggcgaggacagttcagccttggggcgaacacagccgtgagctgtactggaagctgggaagagattaggtgactgtactttgttccacacccggtcaggctctagatagtcactggtgcagaagaaacactgacatggtccaaagaatggaaggctacatcacagtctgtgttctttctttttttttttttaagatttatttat

SEQ ID NO: 17456 - DNA, 1184 bp, Mus musculus
aattcctgagattgcttttagtgagctctgaggactaagagccaagtggtttccctcggtggctttaggaatgtacaaagtatctacatgatggtctccagaaattcacacctggcagctctttacctcagaaagcattgtctctgactctcaagtttgcaaaatggagttcattacccaccaaacctcccccaaagggtttttttgaggctcaaatgagcaacagtgtacaaaaagcctgtgtcaatgatacagcagcagtaaagggtagaggataaatgtccaatgtaaatcctctctagggactgagggaaccctgtcgggaaggcaactcactgtctttttctagggtctaatcatcttcataaaaccctggacaaagactccctccagcttccggaaggtaggctgcactccttgcctggatttatttcccacaactaatgttgactcactgcccaggctcattctcctttcctctcctgcctcgggttcacctaggtctctgcctcatgcagacctcatttggtgatgtgccacactttggcgtgttctgcagcgacttcattgccaaaggagtgagatttggaccctttcgaggtagagtggtcaatgccagcgaagtgaaggcacacagggacaactctcggatgtgggaagtaagtgtgtttctgggggtggggggtgctgaatttggggaggacgacctgaggttgggggaggcggtacccttgaaggcctttattgagaaagacattggtgttcgctccagcaggacctcactctgcatgaaatccacgttgtagtgggtgaagcaactttaatctgtacagatcagacatggaaagtacatttaaagaattaccactgtgtgttttatttacaggcaaaccaagtgttttaaatatgatagagtgttaaaagcatgctacaggaaagaaagacaagttttagactttcatgttactttcttgtaaaattagccaaggattaacaaaacaaataaagcaagttagtgcctgtctaagggaggctgctgagacagcagcttctcgtttacaggacccacttgtcagaataaccaggtaacttaaaatctgaaagccctgaccctggacttctagcaatatactttaggatgataacctgtgattttggcaatgtggaagagctgaattaaacag

SEQ ID NO: 17457 - DNA, 1099 bp, Mus musculus
tgtggcgggaaggggcgctgggcgtgggtctctagagggaggacgaataccgctccgctcccctcggtgctgttgggaccgccggggtcgctgacgtttcgctaaactccttggggtgccgagtcgactcagaaccccttctgcactgtcccaccgagagcgcacacttctcctatctcggctgcatactcaagagcgcctgaagccactgcctgctccgaaaccggtgcagggtcgtgccctagtagcttggctaaaaaaattatattaaaaaaaaaaaaaaaaagacgctcgtagagacctaggcgggtggttcgttttgttgggctgataattaagagagacggaattgaaacccgttttgtaggagccgggttgagggcttgggagcgggggtcaccggcattccttagtcaaggtggtttagggagcaaaagagaaggcgacctgagccagcacctttcagtcgggtgacaccaaggcagattttcgttagaggtttgagacgtttggctttttagttcggtttggtgtgggagtttgtgccttttgtgttacttttttcgagctaggattggcgggatcgaattgggaactttgttcattgactttgatggggtggagggaagtagttaagatcacctaggacccctcactcagccagctcggtttcccacagatccgcaaaactcagcttgcgatggccttaccgccctctggtgagacccagtcccaggacaaggcgaactacctgccccagagcaaccctcaccacctgactacctactacgcgcatgccccaggctacagtcactttaggaacctcgccaccaccgaggaggagtttcaaccttggaaactggcagctgcagtgcttgagtcccaggcgatggcccctcttgatgcttttcggatgactgctcccttgttgaacccgggtctggctgttcagagcgagccgctctacaatctgccctggtacaaattgtcaccatggaaccgaattcctcaattcactcccgaagtaccacgatttctagacagcactgagcataggagcagcggttccagcaaccaaaatttggtcctcggcggcggc

SEQ ID NO: 17458 - DNA, 1221 bp, Mus musculus
gtgtgtgtgtgtgtgtatctgtgtgtgtctgtgtgtgtgtgtctgtgtgtgtatctgtgtgtgtctgtgtgtctgtgtgtgtgtgtccttgtgtgtgttggagaccttgcttaggcaacaattgttccgtgtgagagtgggggctgtgtgtaggtgtcattattcatcgctctcagcttcctacacccatccttttagggtgtagtgtgtgtgagggcacagaagaatttattgggtccccagggtaacacttgtttagttctcacgccgacacttctgggtttgtgtgcgtgtgtggtgtgtgcatgtgtgcacgtgtgcgtttacacacagaaggtgaacactggttagcatttgctacgctctggccttgggcaacatttgccacactatgatttcctgacgttgctagactgaatcaacaacaacaacaacaacacctgcctgtgcaagatgggcaatcgcacttcacaggattccagggaacggtcaagagaactgttaggttaagtgggtgatctctggggacctggggaggaatccaagcgctcgccaatgagtgtggtgggcggggagaagactatcaggggacctccacaggcctgatctcttctactgcctccctctccaagtaccctgaggccggatctgcaccctccctcttaaagcctgcacagccttcgggggtttcagaagtctagggtcccgagacccagcgggtgccgccctagccttggcctgaggtaggtaggtctttggcccgctggagggacctaccccgaaggctacaggcttccagcacggctgggaacagtgctctgtaatcgctttcaaaattcgttttgcagttgtttggttgtttttgttttttctttgttttacttagttagttgtttttggctttgtttttgttttaaacttcgtaattggattttggctttccacctccggagtcgcttgtcttgggagttagagcctgcgctgttcggggctcagggggagatagacggagaggcctgtgtggtggctgacctcgccccctgaccctatgttctttaacatctgagtcacgacccgggttgttttccttattggacacattgatccctgatcttaaaatcctcggaccctacgggtcttcactccttagccctgctgtgtggctactgagaaagaagcatttcgggggccagggccgccgcggccaggtcggcgacaacc

SEQ ID NO: 17459 - DNA, 2644 bp, Mus musculus
ttgttttcatttcaaacaaaaacaaacaaacaaaaaaactcttgatattgccagtgtggtggcgcacgcatttgaaagactagtgtatgggggcacagaatctgccaataggccagggtggcagcagaaaaaactatgcaaacataaagagccccttgtcttcacacaacctttctgtctgtttcccctcagaaatactgctgaccctggagaaactgtctgcatctttcttcaacccactgggcttacaaacatttaccagtctggagagctgcgtctctttgtgttgccacctgacatgccgccagttctcccaggacatagcagcagacagtcgggccctgggcccgcagcatagagcgtgctggcttggctgccaccggaagagttgcctctcccgacagcctgcagctcgcctccagaccaacccgcagtctgttcactgcattcaccgtagtgcaacttagatctcctgcagagtaactgtccccaggccgacttcatccccatcagattgaatgtatttaaatgtgtgtgtttgaggagagccatgcccttggcctgttcctgctcggctccagacactggtttcttgctttgttctctgtggctcttctgtgtaaaagatgagaatcttatctacaggaaagaaaggaacttttaacacagtacaacccaaggtgttctaagcttaaagcctgcatttgactgggatggagacagggcagacactgtgcacagcgctgtgtatgccggcacacctagtcagcaacacgtaaccgaggcagagttctgtctccaggaaggagtgtcccgtcactgaacagatggaaggctcttgagagaggctgttagcattaacaagtatctgttcccacttctctctgttaaaaccaaactagtttcccctaaatcatgaatcaaaaagaaatacttgtttctaaattgtttttagatcagatagtttgattggcatctcttcccttcctctccccaccttctctcgtccctccctctttcattcctttaaagtaaaaacatcaacagcagcatacaccatagagaccagggaagcccttaggatctctcagtgctgtgccagccacttacagcagcttcccagtgaccatgcatttcctatcagagaggaacaaagtcaggctgtgacatctgcttaggtagcctgggctgccccatcagctcaggcctccaaaatgagagaacttactaatgaaatcaacagcagacgtcacgacagatctaacctctgccatatggggttgttttttatttttggtttttagcagtgctgacgaagccgaagttttgtaaggtacataaagatccaatttatatgtaaacaagcaataatttaagttctgaacttaagtgttttaactgtataattttgtgaggtatacatattgtgggattgactcaaaatgaggtacttcagtattaaattagatatcttcatagcaatgtctcctaaaggtgttttgtaacggctgccaatgccttggttagacctgacttgtagacgtaagaccttttgttttctaacccttgagactctcctcatgaatcctgtatctaatctatatgatatgcagccgctgtcagaaccaagtcttgattttatatgtttatattctttcttaataaaccttagaaagacaacattactaagcagcccactttgatggttgttttcttgcccactgtcggggataacctctattaactggtgtcagtttcagacagctgcagtacccagaaccgagaccttttcaattctccccaaccttgatacacacactttcgtacctaaatttcagaatgatgtctttttgatgtctaaaaacaaagcattttataatatctcattatccaagctttctaggaacagagaagattttccttgaagtttgtttattcctggcagggttaaaaacatataaactaccctatttatatttatgtctccctatatatctacagattgtagaaatatagaaagagatgtgacccaaagacaaatggtcagtcatctgaaagtgttgctgcgtgctaaggaactctggaaatttgcatttccatacctttttccacttagagaagaatctcagtgagggaggtggcccaggaacagcgcttccccgttggccaccagttcctgtgtctgctcgagactccaccaaaccattggcttgcacatctgtcctgcaaagggagcagatagaacccagaactccaggccctgccccaggagtgaggctcaggtgcactactgagctcgacctgttctcagataagtcagaaatgtgaggtaggtaaaaatgacttcacacagcacaagagaaaaaggaatttaaaacatacttgttttgtattaaatcccatctcactgtaacatcaagccacaatatcttacctttcagccttcatccaatctcccactgctttctaatgttgacccggctgttagcgtagcccatggtcatggcaaatcctctcacaggtcagagcagccatgaactgtgtgccatctcatcaggaggatcaatcgcatcagcaaaggcatcctgatcatgttctcagagccagggccagcccagcctcccctgccatcagtattgctcac

SEQ ID NO: 17460 - DNA, 2479 bp, Mus musculus
actgttgcatgttttaaagaaataacttatagggctttgccatgcagtggaggacagctccatgtctgtcgtgtgagggctgcggtgcagtctgtatggtctgtaagccctgtaagttggccacagttcctgccctgccccgtgctctctttttaatagtacttacttccctgtaatttgctgcttaagtcctcgttcacattacagatcacaaattttgcctgagaatttggggcttggttcgtacctgcagatatgttgtacgtaacagttagtactcccatttgcttatgccacggacaacaggacaacacctgccttatcttctcattgcagagaacggtgtgaacggcacagtcacatcaaacggagcagactcccctcggaacaggaaagagaagtcttcgtaatggatcggaagctgactgattattgtccccaaagaatctgctttctgctctatctttcagcactagcaatttttcttttctaaaaatacagtttatgctctttgatttctgctgttgtcctgttcctgcatcgtaaagggcattgaggggaggataatcactctgagtgagaacattgtagcttagactcagctacctgccttcagaatagtttagggaccacctttcttttctcttcttttctcctcttttctacccttttctttttttttttctttttctttttgggttgggtttggtttggttggttttgttttgttttgttttgctttgctttttgtccttaatggtttttttttttttttcctaatggtttggggagaaaccatttacaaacccctgcataaccagtgaacatttttcttgctctcaccaatttttttataatattatagcaaggtgacctgttctaagaaggtcatattttttaagttgtcttcagggtaaaatggaaatactataaagtcagatgtcaaacttttaatgttttcagtgttctctaatttttaggaattttttgtagcctttacacctgaaaaaaaaatttgtaaaaatcaccaaaatacttgtgtgctttattttctaagttgtggctgtacatgttacatcccattcaaaagtactgatggctactgcaagatttattgccatccattggagtaggtgtcttattaacataaggaagtgaagtacttaggaagtgaagtgaactttttgtgcattttcaacatttatcaactggcaatcagaaaatgtttattgtgaagaggaatattcaacttacatagccctttttgatatgttaagtaatgattcttaatgggcttgttgtaagtttgatatgcatagcatcttaatgagattctatttaacctgcaagcccttttgaaaagtaatgcctacttgatttctattaaaaagaaaaaggtaccaggtaattctatttgggaaacgaatgcactaactttaaagaaattgaaaatccaggtggatagtcttaacagaggcatgctttatgttatgttagagctttggacccatctttaattgagaaacgtttatctgtataaaacatatttttggataaatatatatatatatatttgtatctacagaaaggctctgaaaagcatttgagtaaaatcttggtccccttttctatgcttgtcctcgcaccctgcgcttggtctgtccactgttgttcagcacatacatgctccatcgtttctcactctgtcaccagctaaaaaatgtccgtgccatgttgactatagaagccacaagcctcaggcctgtggttaagttgccatgctgctagaaagtcatgctttctcttctccagccgcttacctgcttcctgggaaagtagtcgctccctggagcagtaccgactttcagtggaaccaaatttccgcccttaagactggcattatattgaacgatacattgagaaatcaatcgaaataaaaaatttttactttcacaagctgtttcctgaacaattccttcactgtaatgtttaagctattttgaacgtatattctcattaaagtgtactattaaaagatgagtctattttttgtaagcaaatatacttcctggtacccaagcagtgggagcagtcagggtttagtaagcgttggtccctcctttgactggaacctttgagttatttccagcacttgtgttttgtactttagactgtatttcagggtgaggggaaagaaatcacaaagatgacacaggctagttgcttcccaggaccctgtagaaagtgccccttactgccttccagtcctgctgagactggccctataaactggacagagaaaactgtaaagcctcatgggaaacagcctgtgaactaggggtgccactgttagctctactctcaaatggccttgaactacccgctctgggatttgctctttctccctaagataggttcttgcctgaaattggaagagagttggaaagaacctggctggaatattcaagaatgaagattt

SEQ ID NO: 17461 - DNA, 1236 bp, Mus musculus
tcaaatcaggcattgttataaaagtctagtccttaaaatcaagaagtgagcccaaggttgaattttgtgtagaagcctcagccatattgcttacctagtcatcaacaagattcgcctaaggaaggtgcacttttccttactataaaaaaatgtggaatccagtgatgtacttatctcttgtttttactttctgttttttttttctagtctacacaacaactcctgtcaagaaatggaaagccgtcctttagttacagatcagtgaagttctgtcttgttttgcttttagaagatggtattttcttttagctatagattatatatttatagaaaatattaaatgcacaactttgaaaataacccttgatacttgtaatccgtgataattgtaaaatatgtaaattacattttatatctggaggacaggttactgatctaaccttggtcttggaaggttttaccagaaattcagaatctagcactttttcaattttctatggattaagtaaagtggttattaagaataatagattttgaacaattcaaaccagttaatactttagagtttgattgttagggtttctattgctgtaaaaaacaaaaatgactaaggcagctcttataaaggaagacatttaattagggctggcttacagttcagagattcagtccagtatcatcatggtgggaagtatggcagcctgcagacagacatggtgctggaaaaggagctgagagttctacatcttgatctgaaggcagccagaacaagactgtcttctgcaggcagcctggaggaggctctcccaagcccacagcgacacacttcctccaacaaggccatacctcctaatagtgccactccctatgggccaagcattcaaacacatgagtctatgggggccgtttctattcaaaccaccacagttatttgttagcatttgccagtaatactgctttctttagctacttcaatcaacagcacacatatctgcatacgcattccttttcttcagccctgtcaatgccttttacataccaagtttatttcacttttctatcaattatatcatttaagtattgtttctacagttctatgctatgtttattttcttgtaacggtatcccataagcaattcataagttgatcattaacaaatactaaatatactaatttaaaatattatgtgattaataataagtaattcttaaaattttattttatgtgtatgaata

SEQ ID NO: 17462 - DNA, 1350 bp, Mus musculus
tgctttttcagagaacccagattcaattcccagcaaccacatggcagctcacacctgtctaacttcagttccagggcatctgacatcctcatacatcattctgacaaaacacaaatgaacacaaaataaaaataaattataaaagaaaattagaataatgttagctttgcaggactgttaaaaaacatgccacattcattatttccagcatataaccttaacttcaaaaaaaagaaaaaatgtcttcaaatctataaagtaagggcgctaacattagataaagaaattttgaaaatttttctgtagaaaatgatttagaagccacagaaaaaaagaaaaataaatgtatgtggtttggaaaactgatacaatcttcatctctaagtagataagctgtagaaagataaaacaaatggaaatttcacaatagaattattaaacattaacatgggtcactaaggagagcaataagagagacgggccagtgtagcagattctgtagcaaagatgaagacagttcccactgtcccttcactagtctccagagtcagtcacaagctctcgtgtttcatctaggtctcacaagaacgccttatcgcagttaaaacacagacgtgctccatcagatttcagtaggaacgaagcaagaacaggaactcttcagtgtgagtactgttactggagctgtccgcccttccactgcagcacaaaaggctgccttagaaagctagctggtttccatagtccactctaatttgttgtcatgtctttggcactgtttttctgctcagctgtattcagcaactttagactttggagtgataagtgtaatcaaagctcattattcacattgactaagtgaattctgagttagtacttgaagggaaaatacaaaaggttaggtttttatcaactaatcaatacagagtctgattttatgtttgtttctgtttaaagatactgtggtgttggctcattaatattgtcttgttgccagcaccagtataatatgtgtctgaataaaataatatgtaactctttaatattgccctctgatctccacaggtacacatgcatatgcccacacataaataaatgaatataatttttaaaatttgaataaagaatatgaagtgctttgaaaattggctatacttgtgtctgcaaatatacatttaaactttagagatgacttaggcaaaaaaatctgtcctcaaaagccagtcttctgtttctcctagttacctgttaatggcttaccaacataaattagaataattttgttcagtttgaaatctagcagtgtagtctagtcttttatcattattattatttatttttgtttttttg

SEQ ID NO: 17463 - DNA, 1133 bp, Mus musculus
ccatataatctataggatatgtgggtatgatgatgccattgtttccttaccaaaaaaagttaatatggacactttcaacatttggttttatgttttcaactgtccactattgactctgagaagaaaatttgtctcagaaggtggctgacacatttaattttatgttgtattggaactttcagtttaatttttttttttaattactcagtgcctacttggatagctttcttttctttttttctttttttttttctttttttatatatcttaaacaaaagtatttgagcctgtctcattcaaatttgtagagccttttataaacttactccattgagggaaaaagtaaatgcctttcagaagtaaacccttcacatacacaaagattacaaatgtgaacaagcttttctccttcacacacacaaagattacaaatgtgaacaagcttttctcttactataaattaggtcattttgaaggtataaagcagaagaaacaggctaatgatagctcatacaaacctccaaagattgcagctatggtcaatgctggtttctctggcatttagtcatctgtaaaacaatatcctatttatcttcatgctgctctgagttcttttttaacactaggattttctaacatgagtcttactttttttttcaattgtattaaaatatacataatgtgaactgtgggaactaaaaggggtggggaagggaggatagcccacatccagccagagttcctcctatgctctgggcaggcagatatgggagggctgccagacgctttccacttggcctctgggtgggcatctaagccactgaccccatgtccacttgatgggggggggggtggacaacgggcagcccttgcccaggacccctgaggcgacaccctatagccccagggttatgggagagaggttcccatgcaggtgagagtaagcccagtgggccttgatgacagtctatggttttagagctttattatagaaaggcagggggaaagagaaaaggtagaaagagaaagagaggccagccatggccaagaggagagaaggaggaaaggagagagagaagaaaggttgaagagagagagagagaggagaaaggctagagagtaagagggagaga

SEQ ID NO: 17464 - DNA, 1671 bp, Mus musculus
acagttttaacgtagttctgagcacctagtgtgtgtgatacatcaccaggaagttttttgacctactagtaattctctacaaacaacagagagaagaaaaagaaggttgccactgtgccaggaacccttaagaaaaaggttcctgctgggccaaaaactctcaagaaaaaggttcccgctgtgccagaaaccctcaagaaaaagcgaaggaatttcgcagagttgaaggtgaagcgcctgaggaagaagtttgccctgaagacagtaagtaaactttggaggtctttagtgggccagggagcttattgggactgagcgtggggtgagattgaagagagatcttcctggtttgatattctcaagtcatccttgtataaaactgatgctgtgctctgtttcagagccaagaattatgactgactggccattggtttttcagcttcgaaaggcaaggaggaagctcatctatgagaaggcaaagcactatcacaaggagtacaggcagatgtaccgcactgagattcggatggccaggatggcaaggaaagctggcaacttctatgtgcccgcagaaccaaagctggcctttgtcatcagaattcgagggtgagttcactttgcatcgtgttctggcagcaatggctgtattgtgcctgcccttaggaagggggccgagaattacggggggcgggaagttgtttgtgaaacctgtgcctaagctgcttgctctgactgcatttcagtgtcctgtagttgtctaagagcttaaaaacagtttacttagtatcattcagtcatcttttatgataaaacaggaatcaagagaaggcaagctagtagtgatagcgtgttgagattacacacacatactatgtggtgactaagttttgtattacttaaaattacaataaaagctgtatggatctattttttttctctggcagtatcaatggagtaagcccaaaggttcgtaaggttctgcagctccttcgtcttcgacagatcttcaatggcacctttgttaagctcaacaaggcttcaattaacatgctgcggattgtggagccatacattgcatgggggtgagttttctgtctagtcggttggcttttatgatgagatgaatgttagacacttgggctgtattctaacttacctggttttcctggtgcaggtaccccaacctgaagtcagtaaacgagctcatctacaagcgaggctacggcaaaatcaacaagaagcggattgccttgacagataattccttgattgctcggtctcttggtaggtaatgatttttcagggagggattgatactagtccaaggtcatgttttctggccagactttaaatttatttttttacttttattttgtatacgtgtgggtggtggcccaaatgtcatgtgtcttccttaatgaccccaccacacggtggctaggttctccccagaacccagagttgcattccagcctagctgactgtcccttctgtttatatgctgggattacaaacaagcctttaggttggagcttgggtcattggatctgaactcctgtcattcttaagcagcaagcacttccctctcctgagccatttctcccagcctggcttcacttcggacaaatcttgacatacatccttaaaggctctgcatccttaattttgaga

SEQ ID NO: 17465 - DNA, 1103 bp, Mus musculus
acaaaactaagctgtgagcactgtcgttgaatttctttggtagtgacatggggggatttgtacttgttttccattagatagggcctcctccagaatctgttacttctcaagtgaattaacttgtctttacatttaaatgtggtaaaatcatttgtgaatgacttttcctcaacataaattgttcattaactcagacaggatttcaggcatcattatctttagaggcacatagactctgaacatttcaggcttagctcgctgtatagttctgtgatctgctaagtaaggtattagttgacatcttggttctcagatttattatttggtgatgagtctgattacatgatgaggttgtgctgggcttttctgctgtgagcaggcgtccctcgctcgggtgtgcctcgggaaggagaagcagattttcagcaccagttcatgcagcctgtcatttttttttttcttatcctcaaagacaaaacgtactgaaaacattttctgaactctctgtgagacataacttgtcatagtctctggtctatagaaagactgaaaaaattctactgtctgaaagcctgaagcagaactgtgaaggcattctgagattatcagataccacaaaggtgcacgtctcttcataataacaaaacactcagaggccgattgtcagcatacagaacgatttgggtagattattgaattatctagtacatgttccggtcagagtaaatgtgttcctattgctgccaccattcttttggtgatctcagtagagtgtgctcgggatggcaagctcaggcctgagggtttgaacagggggtatatatattttctaactacaaattacaaaaatatgtaaagtaactactatttaactagaatgtataagacagacaaatctgtgttatatatttttcaatacatgtaccaacctttcttagttgaacacaggttactttgtgcgctttatggatcttgagtaacttttaataataaagcagttgtcatttgctctcccataccatatacttgaatactaactggataagtatgagagttctttgcagtttatagtactgtaagctttaatttgtatagtgcgtctt

SEQ ID NO: 17466 - DNA, 1186 bp, Mus musculus
tttactgcatttttactcgtgtgcattctgggcgcatgttgatcgctggttcagtccagtcaaccgacatgcttttattagtcatacagtattaatgcaggtgtcaggaaatgtcaactataattccattttttatttttatttttttaagcttttggaaaagttccaggtcctcgtgtattgtgcaataacagtgacttcctcagtggtttggggacgttcattgccggcaatggacgttgtaaaaggaagagttttcttaactcctgccacttggtgattaatgcatgatagggcctatgaaatgaatttatcagttgttgtgggattataaggaaagtgagggatccaacattacattgaaagccaccccaattgtttatatttggattctatgcactgtgatcctaaggccaacagcatgaaattacatgcatctttaaaggaccgaaagaaagatcattgcatatttatttaattgtttatatctgctgtcaaattgttttgacatggaaagttttcgaggaacattggcagagaggtacaatatgttatccctatggtgaaaataaattcatttgttgtatatactcctcagtctctgaagtgaaggtgtgaataatagagtgtggatggttaaccaaggtgttgtttggaagtaaaagaaaaaatggcagtgatgattaaattactgccatccatcatttgggcctgttattatttttccaagtatattatactctgttacttcctgctagccatcagcatgagccctattgcctaaacactatttcatttatttatgtttggaaaaaatccataaacatttttgtttgtaatcttgtttcttttgttatgttttcagttgtttaaatgttataatactttaattgaaagaattttgtcaagtttttttttcttgtaaattttctttacttgtatcatcttgtccttcaatactgtaccctaaaataagaaatacatttttgacagaggcttaatgttttaacaaaagagtgtggacatttttattttaagattttggtaaaaggatactataaaaacaatgtttgcttatttgtctcacttacccattgtgtagggtttcttggaagaacttgttttgtttgttgagaagattttgcctacagttagatgaagtttttctgtctgcctgtctgtctgt

SEQ ID NO: 17467 - DNA, 1195 bp, Mus musculus
ctgggtaacctcagtatttgttcatgctaagttacttgtaaatggctgcttaattcagtgtgtctagagcatttatgttatgccaaacacttgtctttatatgaagaagtagaagagtacggagagactaaaaaggcagtgggttgcctttaaaggacgttatctgctacagcttgagtatataacgtggaatcagatctgtttcgctcagactgtagagtttcaatggggcgctgtttaccttagcaccagcactcagaacgttgaatattacttgagcagagagttctagactaatctggacaacaaaacaagatcatgtctcaaaaaggcaaaacaaaaggctgggagaatggtttctgaagtagagttttgctctacagttaggaagaattgattttaaccccaagcaacagctcaaagccaggtttgcagtgcccctgttattctagaactggggaggcagaggcagggtgctctctgggattgctgaccacacagtttatttgaatcatggaatactagatcccctcctcctcatatctacacagactgatcctctcctgcccatgtctgcacacactgatcccctccacatgtctgcacacactgatcccctcctcctcatatctgcacacactgatcccctcctcatgtctgcacacactgatcccctcctcatgtctgcacacactgatcccctcctcatgtctgcacacactgacccccttctcctcatgtctgcacacactgatcccctcctcctcatgtctgcacacactgatccccttctcatgtctgcacacactgatcccctcctcatgtctgcacacactgatcccctcctcatgtctgcacacactgatcccctcctcctcatgtctacacacagtgatcccctcctcatgtctgcacacactgatcccctcctcatgtctgcacacactgatcccctcctcctcatgtctgcacacactgatcccctcctcctcatgtccacacacactgatcccctcctcctcatgtctacacacagtgatcccctcctcatgtctgtacacactgatcccctcctcctcatgtctgcacacactgatcccctcctcctcatgtccacacacactgatcccctcctcatgtctacacacactgatcccctcctcctcatgtctacacacagtgatcccctcctcat

SEQ ID NO: 17468 - DNA, 1194 bp, Mus musculus
gttgaggttacaggcgtgtgccactatacctagctgctgttttagttttaaagatttgggtagataatcaattgtccttttaacattagctttctgcctcacaaagtgccatcctgtatgtactgcatagcttaagagtggagaacttttcctacatctaaagtgtcaaactttagatatttggcagtgttggtttgtctcctttgaataatggtctctttctttgtcttttcacatcctcttctctccgctctgtctagtcttctgatgaggatgccagttgtattgtactactgtcctagatagagactttgttttaacataatttaaatgaaatatcccaccttcaagtacaatcacattctgagggagttggacttatgttgaccttgaataataaaaggcactgtgcagccctaacatatataaaactcttctgttttgcaggtcagtttgctgagaatgaaaccaacgaggtcaattttagagagatcccctcacatgtgctatcaaaagtgtgcatgtattttacctacaaggtccgctatactaacagctccactgaaattcctgaattcccaattgcacctgaaattgcactggaactgctgatggctgcaaacttcctagattgttaaataaaataaattataataaactgttaatttttttcagtatttaatacctgtagttcagttagtaattttttcacatatagcatgttgcctgtatgaaattgagctgtaaagctaattgccgagcagattccttctgtcatttgcatagcagagttgaaatttgtttgctacatcaacaaattaaggacatttcacaagtcaaaaaataaataaataatgccagtttatagatggtttgctttctcctggatatgacctttaaaattataactgatagagcaaatcctggaatataaacgtaaatgaatatattctacaggtaaatacaggggctttttatgtttctagtgtttttttaagaaccagttctgatcttatgccactgagcattactagagttatgcaaataattacatggaaaacatgtttataacttagccaaaccttgatttttgtaactcaaagaataagagttgaaatttcttatgtgtttttttataaactgcagtattgtttaagtgcatcttgtgttttgtttattgccacaactcaagtt

SEQ ID NO: 17469 - DNA, 1173 bp, Mus musculus
aagtcttattttacggagtcatgggaagcttcacagtgatcactcccacgctgcttcaccttcttacaaaaggctatgtcattcggttgtatcatgaagccacaagtgacacttacagagctgtcacttacaatgttatgctttcggaaaccagcacagtgtttcaccaagacgacgtgacaattccagagagcgcacatatattcaccagcttttatgctaaaacaaaatcgctattagttaatccagcactctttttaaaccctgaagactataaccatctaatgggttatgacaaaccgttcacttttgatatggaagaagtcgatgaaaagaaactgcatgagggtgaaaaatgaacctgttcttcatttgtgcttaaatgtcatgtattttcagggtataataagattgcctttattttgttattgttagttaatgattgtagaaacaaaacaaaacaaacaaaaaagtgtaagggctgaggacacagcaattggcactgtgtttgctgatgtgaggccctagaattggccttcatagaagcaggatgcttttgtacacttagaatcccagcacatgggacagcgaggtaggaagattagaaatctgaggtcatccttggtaatgtagtaggtttgaggttagcctggaccttgtcttaaaaacagaagttgaaactatcaagcagaatttctgaaaaatttttacatgacaatgttcctatgtaataaaatatgtttaaattaaatatgtaaaatgtggatggtcatgaatattctggtatatgtatggctacatttatttacttatattttgtttttagacagaatcttactatgtagaccagtctgaccttgaattcatagaaatctatctgcttctgtgtgtgccaccacatctgagccatgtatggcggtacatcagaaccggagcggtggctcagtggttaagagcactggctgttcttccagaggtcctgagttcagttcccagcaaccacatggtggctcacaaccatgaggggatctgatgccctcttctcgtgtgtggatgtatatgcaggagagcactcatacattaaataaataaaggattaaggccttaaataaattaaggcatgccaccattacccagtatgtgtttgtttggttttgggtttttgtttgtttt

SEQ ID NO: 17470 - DNA, 2270 bp, Mus musculus
aggagggctggtgtgatggctcagtgtttgagatcacagactgttcttccagaggttctgagtacaattcccagcaacaaaatggtggctcacaaccatctgtaatgggatctgatgccctcttctggtgtgtctggagacagctacagtgtatttcaaggaaaggcatatgaaaggtttggagagatggaaggtaacaaggaaataatgtgacttaattagaatctcgagtataaagtagatatttttaaatgtttgtttcattttcatgaagatgtagtaagaaattttagtcctaataagcctgtataaaagacacgcaatcagcgtgtctctgaggtatttgctggttcgagagtggaactatgctctatgcccaggtccattatccgttcgagagcaagcgcgagtttgaggatgcctttcccgcagacttcattgctgaaggcatcgatcaaaccagaggatggttttacaccctgctggtactagcaacagtgctctttggacagccacctttcaagaatgtgattgtgaatggcctcatcttggcgagtgatggccaaaaaatgagcaagtggaaaaagaactacccagatccagtttccattatcggtaagtatggtgcggatgccctcaggttatatctgatcaattcccctgtggtaagagcagaaaacctgcgcttcaaggaggaaggtgtgtgggatgtcctcaaagatgtgctgctcccgtggttcaacgcttaccgtttcttcatccagaacgtctttaggatccacaaggaagaagtgaagttcctatacaacgagcatacagtcaaagaaagccctaacatcaccgaccggtgggtgggttctgtccttcatgcagtcgctccttggcttctttgaggccgaaatggcagcttacaggctgtacactgtggtacctcgcctggtcaagtttgtagatattctaaccaactggtatgtccgaatgaacaggagaaggttaaagggtgagagtggggtggaagactgtgtcatggctctggagacagtgttcagtgtcctgctttctctgtgcagactgatggccctttacacaccctttcttactgaactgatgtatcagaatctaaagctgccgattgaccctgcttctatccgggacaaggacacactcagcatccactacctcatgctgcctcgagttcgagaggagctgattgacaagaaaactgagaacgccgtgtctaggatgcagtctgtaatcgagcttggaagagcgatatgagaccgcaaaactattccaataaagtatcttttgaaggaaattgtggtcatccaccaagacccagaagctctaaaggatatcaggtccttggagaagtatatcattgaggaattaaatgtttgaaaagtcacgctgtatactgataaaaacaagtacggtatccgactaagggctgaaccagatcacatggtccttgggacgcgtctgaaggaggccttcaaagcagtgatgatggccataaagtggctgagcaatgaggagccaagagtggtttcagacgagcgggagcattgctgtggaaggccacgaactgcatgaggaagacattcgcctcatatacacctttgaccaggccacgggagggaccgcgcagtttgaagcacactctgatgctcaggctctagttctcttagatgtcacacctgaccagtcaatggtggataagggcatggctcgggaagtcatcaatcgcatccagaagcttcgcaagaagtgcaatctggttccaacggatgaaataacagtttactataatgcaaaatctgaaggaagatacctgaattaatatcattgaaagccacactgatttcatatttgccactatcaaagctcccttgaagccatatcaagttccaacatcagataatatccttattcaagagcaaacacagttaaaggggtcccagctggaaatcacgctcaccaaaggatcatgtgtgtgtgtgtgtgtgtgtgtgtgtgtgtgtgtgtgtgtgcctggccctgcttgtgcttatgtgaaccttaacatttgtgcaaatggcacggagcaaggtggagtgttgctcctggagaatacgaaaggtgataatcagctgaacctggtgaagctgaagactgttgttaccagcgtatttggtgttaaaaatgcaaagctgtcagtcttccatggtgaaacagaaatacagaaccaaactgacttgctgagcctcagtgggaggatgctgtgtgtg

SEQ ID NO: 17471 - DNA, 1187 bp, Mus musculus
cactttttatatcagatatatcagagcccagatagcacattagtgtttgtagataagagtgtcatatttcattttttgttagtgaaattttacggtgtaaagtacagatctggtgtgtgggctaatgattacattccattcaaatatctacttattccgataccccaaagcagaggcctttggtattttgtgggaaatatgaaagaacctgacctgaatatatctgttttcctttgcaggtgttcttcaacttctcaatgtagaaattcagaacatggggttgccattgtattcatctattgaattcactggtgtatcagctggatcctgggtaatatcttctactgtgcatcaaagttgcagtgtgggcatccatgcatcttccagccatggcgtgattttaactgataatgtagtgtttggcacaaatggccatggcatcgatgtggagggtcagaactattctctcaccaataaccttgtcattctgacaatgcagtcagcaaactcatctccttgggtggcaggaatcaaagtgaactatgcagaggacatcattctccatggcaatgtggtggcaggatctgagagacttggctttcatgtcggtggtcatgggtgctcctctgaagtgctttggtctgataatgtggtccactcaagcctccatggccttcacctctacaagaaacatgaatccaataactgtactggtgtctctggatttatggcttttaagaactttgactatggtgccatggttcagacagagaatagtgtggacatacagaatatcactctggtagacaatactgttggtcttttggctatcacatatgtatcttctgctctcctgagctctgtcagtactgtacagattacacttaggaattcagtcattgtggccactagctcctcttttgactgcatccacgacagaaaggctcctcagtcagccaactggacatcaacagatagagcaccttccaatcccagaggaggccgaatcggtattctgtggcctgtttctgcctcagaaccaaatgcatggccccaggagccatggcacaaagtaaggagccgtcattcagtcccaggaattatgaagcttcaaggtaggattcttgactttgccctaaatatatggatccatccacccaaacacacaatgttcagtagtattctga

SEQ ID NO: 17472 - DNA, 1115 bp, Mus musculus
ataacactaagatattatgggaggaaatacaaataaaaggttgattgttgtaatcattatgtggtgaggttctgggcaattattgtcttttctttattaaaatattcaaaataatacataataagcatatataatattataatgaagcagaatgcaaatgtttaataagcttggaatatattttctcaaaagtgtaagggcttggaagtaactttcttgcttgccataaatattttctagatttctaatattcaagccagctaatttgagaggtgaagataccagtcttaaaataaaaagagaatcttgaacttgtcacaatgtctttggttttcatagttttaactctatatatttcctgtgtattccagcttctacatcagtacctgaatcagcttcaagatggtctcttcctgaaacatggcaagatgttgaaaaaggctggggaggatacaaccacaccatcccaggacccggtgatgatgtcttgattttacccagtgagtgaaaccagccaggaaaagaaatggatggatcgaactgaaccaagtctgatgggggataagattgaatgatgtaatgcaagataggaaagcagatagaaataagtagctacttacttttatgacccattgggggagggtagcctgggagaggaatcattgtgagttttttgaggaacctctatatcatatatatcgtggctggatcagtttttgttcctactaatagtaagtgagctttctctccctctaatatccttgccagcatttactgtcatttgttttcatactagtagccattctgcttagctgtgatggaatcttcagtgtagttttgatttttatttcctttatagctgaggatattgagtcctttttgtgtatgcattggagttataatttcttctttgagaactttcaatcaaatttatttatttgttgattagattatttgttcttctggtgttgaattaaattattaatttttgttctagggattggattaaggactttttatatactagccaagccctcaaccatgaagctacatctccaactcttgaactccctgtatattctacatattaatccctagtcatgtgaatgcttggc

SEQ ID NO: 17473 - DNA, 2337 bp, Mus musculus
caggactcccagaaagtggaactcagtgagcccaggtgagttcttccggggatgccaccagccgccgccgatgaccttagagctagagctccaccgtgattaccccaggctcgcccagggtgttgcaaaccagtgtctaaaggctgtggcgatttggcagaactgcttgcttctatctttgtgcaaatttaaattgttacttttaagtcaggaggaactggcttgacttaccaaggtcaaattttgatttgtagcttactgtagccttggattcttctcattggaatatttctttttttttcccccctcataaattgtggccactttttttgaaaaccatattttcagtagagtttcagaaaatactctttttcctgaaatttatgtttaccagacaccaaagaaataacatggctaaggttaatttttaaagatagaaagtacagcccagccaaatgtagaaaaatacttaaagaaaaaaacactaaaattggctgtaattgtactccagaaacagccattgaggtttgctttctgaaccaactcagaattcactgtcaatagctgctgtctttctaggggccgcagtgtgtagaatctttggtctcgatgtgtaaacagaatggtctcacacgctgagattgccccttccctcgcatccatctcgagtgctccgattaaaggcatgtgtccccgtcccccagattgagatgtaaattcctaatcaagtccttgagtggcactgaggtggctccatgtcactgccgtccattcacaatgagacattcttaggtttgccgcctggcacagtcataaggcgcagtaaggtctctagactggagaagagtcatgggcttccattaaatcctgtgtgtaaactgtctcctagctgtcgtgctggccagtttgctgtgccgtgtgtaggattaccagtctcttgacagcctccaggtttcagaggctcctcgtgcctgaactacaggaagctctgcttgcagtgtaggttggtttagaaggatgctcagaatattggaaagacactttcccgtgtcaggcttgtcttagctgcaggtgggtttgctgccattttgttggtttaagacaaggtgatgttgggggcttcctcagtgctggtatcagacgtgtgctccaccagactggcctcctacttcctcacgcttttcctgtcttgtgcaggctgaaggcttttaaggcggccctcttagaagtgttccaggaagctcatgagcagtctgtgggcatgctccacctcacagaatccatcaaccggaatagagaagagccgttctcctcagaggaaatccaggcttgcctgagccggatgcaggatgataaccaggtcatggtgtctgagggcatcgtcttccttatctgaagttgttgctaccaagtactgccctgtccccagcctttgtctcccatcctccagtaacttttttaagggatggaagctgatggtgagacgatcaggacttggtggaagctttgtgtatgacttctgccttggggcaagagctggagggagggccaggactcaggcagaaggcctgcctcacaagccccagtcctaaacatggggagtcttcatgatttgagctgtgtttctgggcacagctgtgtcctgcgtttgttacttgtgtttttacccccacccccaggcactttagtccaggaagctttgaggtctgttgggccaagagtggctcaggcagatgacaaggttggattggagaaagctttctttgcaattagactagtatgtattgttgacctaaatatccaagacattcatactgagtaaatataactattttgtacatgtggacttcatgctttgtgctttaaaaaaaatacatttatttatttgtctgtgtgtatgtgtgtgagggttggggctgagacctcctgggacacacttttggaggtcagtggacatctcatgggagttgtcccctactaccatgtgggtcctggggatccaactcaaggagtcaggcctggcagagggttcctttaccttctgagctgccgttcaggcccgggcccactcgaagatttcttttactttcattacaaaaacattgtcgttaaaatcacactagagaattcaatgaacttgtcaaattttagagtagccatggtacaagaggctaccatcacacggattttatactttccactcttgtagatacatttatgtacttatctacccaccaccaaaggggacaacttgatgacagagttagaataaaatgaggcttgctatccttcataacccaagtccctttgtccttcctcatgccctagggtttagcc

SEQ ID NO: 17474 - DNA, 1099 bp, Mus musculus
agaacgattgattttctgctgggtgtggtggcggcaagcttttaatcccagcacttgggaggcagaggcagaggcaggcagacttctgagcattcaaggccaccctcctctgtctctagcaagttccaggatggccaggtcagtcagagatcttctctgaagacaggacagacatttacttttacgtgcatgtatgtgtgtagcgtgcatctgagggtaagagacgacttgggagaggtcatatctctcctcctgtattgatacccagtgatgtactagaggagcactcgaccactgagctatatcctggtccaaattgtcggctctcctgctatattttgtgtggtctagccttacagtctcaccccaggattgatttggcttcgatgtttgttcttcttactgatgtcccttctccttggttgtcctcttgttctccagtatgatcagtataagacgcccatggagaacattgggctgcaggactcactgctgtctagatttgacctgctcttcatcatgctggatcagatggatcctgaacaggatcgggagatctcagaccacgtcctgaggatgcaccaatacagggccccgggggagcaggacggtgatggtgagtatagagaatactacgattggctgctggaggggtcctaacggatactgctatcattgacaacatcctgggttaatgtttccagtacccccaccttcttgtccttctccccttacttgactgctcactggaggttgagtgtccattttggggtattgctgtatctcttttgagcagttctaagtttcacatttgtgaggtccatgtgtctcttccttcctcctgggttcctgctttcagctcttggtttcgtctctttccatgctggaaaagaggcagtttttcttggctttaactccttgatgttttttgtctcaacttgtgtttgctagctttgccattgggtagttcagtggatatcctggccacagacgatcctgactttacccaggatgaccagcaagatacccgcatttatgagaagcatgacagccttctacatgggaccaagaagaaaaagtgagcctcttcttgcttctt

SEQ ID NO: 17475 - DNA, 4946 bp, Mus musculus
cctgagccgccagatggcctcacctctgtcctatcttgagttttctcagaggcctgcattctcctgattgtcttcctgctccttccctcctcctcctcctcctcctcctccttctctctctctccctccctccctccatccgtccctccccctgtcctcctcccctctccctctcccccctctcctccctcttcccctctctttctctctcccccttcccccttttctcaccttcctcccctctctctttctctctctctcatggctgcttctcatcctcctttcttcctaactttaatgtgcaatttctctgatttgtacaaccggggggagctaagatggcagccctgcccttgggtctcagggcttgccaatctggaagcctctggccaaggagcctcccctagagctggtggcagatcctcggtggcccttgtggacagattggattacaatattcttggtgctgaccgacagacagtcaagatgtaggattctggttctacgcatccttcgctttggggacatagtgacttaatccagaaagacagtgttaattaactattgagtcccaggactccagagagcttccagtgtgtcatttgaattggaaagcagcctgccttcactctctgaggggacatgctaaggaggatgtgccttcccacttgtcccacaagagcaaagcacatcaaacatctgcctcttctagaaaggtggctcgacaaacagaagagtcgatctggaccattctccacccaccagcatctgaaaccaaaccaaaaggcagttacaaacccgcccaagacacgctgttcccaagtccagagatggcctgccccagccggccaaacttgcaacctcaacttcatctctctgcagaaacaggaagccccaaggactccatcgcccgccatgtgttcctttggccaccttccctctggcctcacctgagtgttcttttaaagttgttaatgttgtttgttgagcacacccagagcctgacaccaggatgcctcagggttactcttctggttgcatgagctgacacagccatgtccacaggagtctgtgacccccttcccttcggtgttctttcctctctcttctacctgaagacggggtcatcaggtccttatggtaccttgtgaggacttttagaatggatttaggctttaaagggtccccaaactctgagctagagtataggggagcagttcttggtaacacaagacattaatgttacctaatattctgcctggccttcctttgacaccatatctgagaccagagcttgagtgtttacccataaagagggagctgggtcttcagcaagagctcccttccaagccactgacgatggatgtaaaatctagtttacccacaactgaggaatttggttccaaacaccaacgtggcattctttttctctgtgtccagcttacacatagacatgctggatgtgttgagcatacagaatagagatgagatccccttggcttcttgtgtgtgagcttaggaaacaagacagaattttgaaaactcattcctctattctctccctcttctttcctggcccttctctgggcatccccaaagaattgatctggcacctttcagccagtgtagcccacctatccgggtagggattttaattgagtttatgctttgaaatgccttctgttgctgtgtggaagctcagccggtggctcccaagctcaccttaccccatcagtctaggtgacctcctggaccatctccaagctaagagcctgcctccctaagttgctggcaggcccttgccagctcactgcaggaacttcgtctctaggctgaactacttagttactccttaagtaaatacttgtgacaagcatgagacatgtgaaggtcttggaggaacaggggtataaagagcagctgtcttggatccaggggtcctgtccctctggaggggtttgttattcccggtacacttagatgcctgagatgatatggattcattccttagaagtcttgcaagcgtcctctgttgctggtttgttgggattgatctaggctcttctagaacataaggtcagtagtaggagtttggggtgttcatttccagaaaagcctgagaccaagggcagcagctcgccagccttgacttctgggctgttagcaggcttgggagaactatggggtgctttctcacccacccagcctctctggcattgatgttataggaaagccaagactttgtgaagttggcacaaaccttgttgccagaattacagaaactaagttccacaccatccttcaaacatgcaggctagcatgtaatctgggtgctctggccccattctttgtttttatgcaggctctcctgtccccaaagtaccacacccttagtgaaggacctgccatactccgccaagtttgagatgttcagtaccatctaccaggaccagaagattctaatcactacctcagcagccactgcctgtctctcaacatccctggaattccagtaggtgccagtggcaggactggtggaccgagaaccccctgttgctagttgccctccccagaggtgtggtgactcaggggacagttacttctacaagctcctcaggcttgggtgcctacactatgaattagctccttgtcttcctcctatggtcagaggtggtcctggggaagaagaagcaggctaaagccagggaaggaggctttctgctattctggtcagtcctagccctgtgtccctaactggttcacagcagcggcagcagcagcagcatgtggctagcctaagggtgaactttagtcacttctatttagatgactatgctctggctactcacacagtacttttgaagagtgcctgggactgtaagagcccctgaaggtttattcccctgtttagtcccctccggcattttttttttaaagtaggaacagaaagagtgcattttccaaaagtctacaaagctcacttagattccacacatcctcaaagaaacttgctgacttcttgcagcgagggaaggccttcatttgcatttgtctttaatggctttcagccttcctggttgggtttgctgaagtctggagtgggaggaggtatagggtccgggcttagggaactttctctgcttgagggcctctgtgtctacagcacattcttctctctggctctgttctggtgcggcatggaccgacaggcagtgagtcagaacagtgagctgctcttccacctccctcggcgtcctgagtgcagcctcttccctcagaacaggatgctagggagaacatcaatgccaggcttttgaaaacatccgtagaacccttctccagcccgtggtgagcgtgaggaggatgctggcaccgacttctcgccctttccctgccttttaatacaagtgttagctccattacatctgctttcaaagctttgcagatgagaagaaaagtcacgccgagtggcctctgtgaaacttttgttcttgtcctaagcaggtccttgtcctgtcactctaaaaagtgccttatattgccttgtggccttcactggtactgtatggcctggccccccaactgccaaggctctagggctgactggcatacaaagccaatgacagcatacctcagtacagctccaggggaaagggacatgggttgacagtatgtgtcatttgttatgaccctcttctccctcacacatagcgtgagaccttgcttgttctcttttttttttttttttttttttctagtctcccattgtctgtaccttctggctgtggaagcttgtgaggtaacccagctgcagacacccatgcctcctgtctaataagggaagcttgggggttgggaaaaaggtcacctctgtgtacctctggccctgtgtggcgagccctgctcttccagtttcctcattcccaccccaggttagaaacagcaccctcttcctatctgttttagttccatgtagcccagagtctgtatgaggaatgtgtttacttgtgctcccttgttccaagtcttagctcattggtaacctgtttggcagtgcctgtgatctggtagctgcaaagctcctggattcctgtcagggttatcttgtgttcctagtaccacaccaatcccctccctgaccctagcctgcttgcctgcctgttcccgcctgccattccgggttgtgcaataaccctcccagccggtggtcttgtcccttactgcatccatcctgcaatatctggagagaggggacccacaggagaggtcgtcatcatcccttacagaagtgtcagtcccttcctattgctgtcattcgcacggccctgcgtgggtttctgtggcaatcttacagaatgtgttgtgacgtcttcgagatctttacgttgttttaaaaaataaaataaatgtgttgaagaaaacaaaaacaaaagcatcctcagaccgggacattgtcagtgtctggggataagatcagtctggagtcgctgacatcactatcatcaccaaaggcattccagggtttcttgttcctgtgcaaacaatgggccatgtttccaagaatcagccacagtggtgagccctgtccgccccgctactgctcgcccacccccatgatggggcctggctgtggtggtgagtgctgcattctttggggtacagattcatgtgtgattaaacctcacttttcagttactctgtttaacacacacttgaaggatgagcggaggagctggtgcccctgcgcaactcacaatgcaaatgtggacactttgactgtttttctacattagcctgttcatgttatggaccaaattcaacaaggaactcaaggaaaatgtgtacctgccatatttatgctttcttattaaagggttgggggaggggcgtcttacttttggtgaagtcttttttttttttttttccagagtcctttttccactgtt

SEQ ID NO: 17476 - DNA, 1195 bp, Mus musculus
ttggggtgagtgggttggtgagtggatgggcacgggtggggggatggctttcctgtagctcagctgtcttcttctcgtgtgcctgtacaagagccgaggatgagcacgggacctaaattgccaggaaggaaggggaaggggatagaaggaggaacctgcctgcctccgcccacacagattgtgacatgtaacttgggcacccttgtcttctcttttgatttcatttgtgatttgagttagaatcggttcagacgtttgggcttagcatctaattatcagtgtagagaactgaagtagggaaggaagaaaagcccatattctgacggaatcagagtcaggtccctggtgtcctctgcagggttgacccgggaagaggacagagcagatcgcataggccctgcctggcctcactgtcctatgtactttgctctgccagatcagattttgtcaccccagctctctgtgggcagtttgggaccttagacttaaaaaaccctatttttcacatttagtcatagatggatgtctctgtgtgtgtgactctgcccctcacccctgttgtgttcttctgcccgacccccaaatcaacctggtgacctatccgaccttacttccccttcttctcttctttcctactctgaccaagaaagcggcttgctttcttcctcacaatgttgggaatggatcccacacggagaggttttctttgttttcagataggctcttactctgtctacactggcctgaaatccacttctgagaactgaattgcaaatggacagcatcagtacttaatgatcttctaatgcctaatttcaagtaagaagagtaagttacagggcaccctaagctacacagagaaaccctatcttgagctccttctcctcaccccccccccaaaaaaaagaatagaattagtcattacagctaacatttgaaacattacaggttggggaccaatgagacagcttgcgggtaaaggacccttggtactatactgagcctgatgacttgagctcagtctctgaaacacatattagtagagagaagtttttctctgactctctctctctctctctctctctctctctcacacacacacacacacacacacacacacacacacacagtaagtaaataaataaatgataaaatgaaataccacttttttttttttttactgactccaaagcag

SEQ ID NO: 17477 - DNA, 1129 bp, Mus musculus
catctgttcagggaatattttcaagttgcatctgggaagttgggacacaggaaaaatgagtcccccttgcttcctctgagaagggcggtgacagagccctcagagcccacagcacagggacatgacagggcagtacacagcaggcctgtccatcagcgtgactgtccctctgtcttcctcttcctgtgactcagcctcatgatgatcctgagacttgtgctgctgctgctgtagcgtctggacaagctgagagccaaatgcccagcatgctaagtgcctggcacggcaggttcctgcattgaagtggtcattttaaatacatgggaaatgtcttatattgaaatgaaaataatgtcactataatatttaaaaatcattggcaatgtttatttacccccaatgcctttttatttaatgcacaaatttatttagatgtttctgtttgctaatcctgctctttaatgcattgttactgctcattccctttgtctctttatatctggaaattggggacttgcaattttctgcttttgacaattccaaacactatgagtgaaataagttaaataagttaactgcatcctgtcagacaatgggattcctgtcgtgggccacagggagtgttaatgaattataagtcactttgtacttaggggttttatttgtattattgggggtggggcaggtttgcatagaaggaattctattctcagcacatcagcatcctgacacaatgcactcagtgttgaaataaaatgcatcttagtctaagccttctcattcatttctatgtcttttctagaaactcaatcactcaatcgtttaggctgtaacatgttctttagtagtgaaaaggatgtcagggagggttgtttacaccagatctccatacttctcaggagcatctctctgtcccccacacgcctgtgagaccacacgccatgtgaagaccagttataacttgtaatgtccaaggcagtttaggaaccagatgaaccatctggagacccctgcctatttccaatgtctgctatggtctctgggaaacctgaccctctctgggcgactcagtttctcatccctatgggggtggatattaatgggtagcttgccctccaaggtagcaggc

SEQ ID NO: 17478 - DNA, 1176 bp, Mus musculus
tgcagttaaccctttgatgcttcagcagtactgaggatcccataacataaatagcccgagccaacgttgcagagatgacagttcaagcttattgtagatgccatagacatgagaacactgggaaacagagaggaagaaggtggtcaacgaaacggtctgtgcgtgtgtgaagggtgcagtgaagccacttcccaaaagagactacagagtatggcgaggggcacccccacatgtcagggcttcatccttttaggatgggtaggaagaaatagtgcagctggagctaggagcttggcagggctctaagatgtagggaaggacagatgacacaatgatggtcagagatctgcttcttgattttatcatgagccagggcctagagacaagcatgggctccatatgcacccgacaaggaagcaaagggacattcaaggggccccactctgatgccagttgtcttcaagctttaactaacaacttgaattcctcaggtgttgaagagccatggacaagattatctcgttggcaacaggctgagcagggctgatattgccctggttgaactcctctaccatgtggaagagctggacccgggcgttgtggacaacttccctctcctgaaagtactctacatatcttacctcatgggaaccaatatgttgaccataagggtgatcctgatgcaacttccagctactgcctgcctccatagctagccctctcatttaacctatgagattcgactttagatgctagttctgagacataaaaagaatcctgttacatgaggaaatctgaggaggatgctatctcaggacatatgactttgtcttgtataatggaaagaacccaggacccccccctctctccccacactctatcctaccttggatttgattctgatttcatgggatcctctctatcaaaggtgcagtcttgtccttccacactgaatgtatctggagaggtctttttcaagcttctatattaatgaacattgtatttctgtagcagtgaatagctaatctgttaactagttaacagttaatctgtcgtggaaatatgtttgtaaaggaggtgtgtagagagaaatatgttgtagtggtgaatagtagtgaagagttaatctccactgagctttcagcggctgattgcacttctagccacctgccagag

SEQ ID NO: 17479 - DNA, 1968 bp, Mus musculus
ttcttgacctcaacactattgacatttggggggtaaatcattcaatgttcattgaaatgtaattttcaattgggaccaaaatggcacttaaaatatactctgttcctaactaaagagatatctcaataggtaaagttgccattcctgacagcctgattgtgattctccagaacctacatagtagtatagaactggctgctacaagttttcctctggcctccacatgtgcagtaggtaacatagtggaagagcctatcacacattgtcctctgacattaacacacatgctgcggtgagtcatcccaataagttataaataaagcaattaaaaaaaaaaaaggtaaccctgtacggcaccgctcccttttccggtcggcgtgtttctgcatcggatcgtcttccgcagcccggccttcaccatgagcgtcccggccttcatcatatcagcgaggaagaccaggccgctgaacttcgagcttatctgaaatcaaaaggagctgagctctcacaagaaaactcggaaggtggacttcatgtagatttagctcagattattgaagcctgtgatgtgtgtctgaaagaagatgataaagatgttgaaagtgtgatgaacagtgtggtgtccctcctgttgattctggaaccagacaagcaagaagcattgattgaaagtctgtgtgaaaagctggtcaagtttcgggaaggcgaacgcccatctctgagactacagttgctcagcatccttttccatgggatggacaagaatactcctgtgaggtacacagtgtactgcagcctcatcaaagtggcggcatcatgtggagccatccagtacatcccaacggagctggatcaagtgagaaagtggatctctgactggaagctcaccactgaaaagaaacacaccctcctaagactgctctacgaggcgtttgtggattgtaagaaaagtgatgctgcatcaaaggtcatggtggaattgctcgggagttacacagaggacaatgcttcccaggctcgagttgatgcccacaggtgtattgtgcgggcactaaaggatccaaatgcctttctttttgaccatcttcttattctaaagccagtcaaatttttggaaggcgagcttatccatgatttattaaccatttttgtgagtgctaaattggcatcgtatgtcaagttctatcagaataacaaagacatcatagattcacttggcttgttacatgagcaaaatatgtcgaaaatgagactcctcacctttatgggaatggcagtggaaaacaaagagatttcttttgacacaatgcagcaagagctacagattggagctgatgatattaaagcatttgttattgatgctgtaagaactaaaatggtctactgcaaaatcgatcagacccaaagaaaagtagttgtcagtcacagcacacatcggacatttggaaaacagcagtggcaacaactgtatgacactcttaatgcctggaaacagaacttgaacaaagtgaaaaatagccttttgagtctttcagatacctgaatttttatgaaaatgattttgttcgttgagaaaaaaaagttctaagtaaaacattatcaactgaaatttgaaaaaaaaaaaaacaagtgaaactttactaattcgtaggcttgtacatgggatatgttcaagctgagctgcttgtctggccacagtaggagaggaagcacctaaactcacagagacttgaagtgccagggtaggaggatacttagggctcccccacctgttcagagaagaagaggagggaagatgagggaagaattgtgggaggagggcagagagctgggtgtaaagtaaataagtaaaaaataagtggtcttttaaaaatactgcttctaaccactagatatcaataacaacttcctcccatctgtgacaatcaaatatttatcttaaaatctacaaatgagcccttgggaaga

SEQ ID NO: 17480 - DNA, 1171 bp, Mus musculus
agtatttacaagggaggcttttggctctttgctcaaaatcacataaagttgattttcaaaaaaaaaaatcaaaaatcacagaaaatgtgtataaacataaaattcatctttatgtttttatacgttttattgcaatttacatttaatacttttaatgtgtatttgtatacaattagttcatatgtgttaatataagtgatatataaattttatattttgtacagtatatgagttttgattacataagtacttactctcatagaatactttaacttttaattatattaaatattaaaatcatccctacaacattacctaagattaaagtagaataactttgaagagtacggtatttttatattagaagaatagtacaaacaagggggatactaaatagtaaatctaggtacccgtcacgcttaatgctttctgctaatcaaatataactcgaaacaaaatttcaaggaattaagaaaagaaatgaatgtgatcagaatacagctcagcggaatccaagatgccatccccagggaatgacagggttgagggaaggggtcaacgtgggctataggcttggaagtggcaggatctgggaatgaatgagtggaggacaaagaggaatagcaaggagggtacaagcttgaagagaagctgaagtgaggaggggctgacaggggaccccaggatttaggaactgagacatttcctctgacttccttttacacagacaattgggggtaaggatagaggatatccccagtgtggaacacgcttatgcacaaatggatgctcaccccaccctccttcttatccacaaacatcacctcacatccacttccagtctagaatcaggatggccatctcagggataatggaggcaggatagaagatgctgtgtggaggaatagtccaaagtatggggctagagtgaacgtcgtggaggtgatacatggccatccccaccacctctgaagtttacgcatctggacaggttcacggatagaaaagtaagcaactaggagtaattggaatgaatttctcttgtaaaagttgagcatcgagcagtaaagatcagctgtggcaagtcctcattccttccagtacatcatcactttctagagcatttttaataaactgctctttgtaactgaggaaggccttgcatgctcct

SEQ ID NO: 17481 - DNA, 1148 bp, Mus musculus
tttgtataggcagcagatattcatcgaaagctacgagacagaattcatggcataggatgaatacctataaaaagcagagggttgtcaattaagtagtttccaggtgacttgtcagtttccaaggctgccaagtgagtgtgcatgcatgcaagcatgcccatatgtgtgtggtgtgctcagtatgctgatttagctatagctaaccagcagcagtcagttgtatgcagtgaaaacacagtttcatggtaaagttgctttcacatcctcaccaaagagagttgagaacacttcatgtcagatgaagatagagagtgcctctttctcattcctaacacgcttgctgcccgttcgtgtgatctgaatcatgttcaccttcagcttagcagttgttagctgctgtccactctgcactgtgaatgttcaatcgattaaccatggcctacttctaaagtttgttgagtttgagtcatttcaaaagtgttgaaagcttaaccagttccctgaaaggtgcttcgtgtattttaatgagctttctgttgtgtgtttttgcagcgagcttagtagtggaggaacgaacgagacagatgaaaatgaaggtacaccgatttaagcagacaacagggtctgggtctagtcaagaacttgaccacgagcaatactccaaggtaaaattagtagtatccagccaatagtgtcccctttagaaaaaatggaaataagtactaggtatgtgtgtgtgtgtgtgtgtgtgtgtgtgtgtgtgtgtgtgtctagcacagaattagagagcgctgagctgtgtaactgaaattttctgtaactggtagtctttatcatagttgttcctgatgcttgacacgcattttccacacctttataatttaagaagttacattacattacggagatattatttattacatttcccagtcattccaatgaggaaacaatgttcttagctacatttgcaaaagtgagcagtgtctatgaacccacttgttgatgaaatagtagtattttaatttagagtattaaatatattttatgtgatatggactattgaattaatgacaacagccatataatgtgatagttttgcttatttgtctttggttaaaaaatacatgatgttttaatctttaataaga

SEQ ID NO: 17482 - DNA, 1635 bp, Mus musculus
aggtcatttaggatgttaatagagaggtatgagtattttgtaaatgttagggtaattttagatgttttactttctaaaatgtctcagtcttggagtcacagaagagtgatggtctcagatataaactcaaagattactttgatgtgttttcagttgtggttaatctagaaagtgaactaattatggattactttataagtaacacctaactcagaaaaaagtaagaaaaaagtaactgatttcagtagaaagacttcagtgtagtccacatccagtgtctggactaattttcacatctgatgaagtgtctggctgtagctaaggagtcaggagtgaaaagagggtcctccttgtaaaccaagccttttgtgtttcgcagatgaatcagcagatggctgccatgaacctcagtagtgctaacgctagtgcaggttttggccagcctcccagcacgacagcagggtggtctggaagctcatcggggcagacgctgagcacacagctgtggaagtaagaagctgtcacagagttccatccagaaccgaccccaacattcctcgctgcaaaggcatctagttcccatttattcatgtacataacgtattttttctttcccccatttgctcacattaagaatgacctgattgaccgtgttggtctgtgctgattaaattggatgtgaaagcaggttgagaaaccatctgtgtggagggcagctttgctcatactccccatgatgtcctaagccacattgggaagctgctcagttaacttgcataatcagttttatttgcaaaattatagctctaacgtttgcatataagggaagtagttatcatgttagtaatacctctaacagtataaaccccacccccaaattagccagtaatcctgtagaaaggtactgtatgatcaaatgtttaatcatataaatagaatgtaaatgtatcactgagcactgttttctagtgtatcaaattcttttattcatcactcactccactgtgctgttgttatgatgtgcttaacagggaacgtggttagtgaacggagataaacctggatgctactgtaaaactcaatgaaggtttcagaattcaaatttccattgcctcttgtaatgtgggcctcttctcatgtacatagtgctaatatgaagacctttttctgcactatatgcacacagggtaactaaaacaaagccacttttaatccttgaaggtatatccaggtttatgacagtaattgtgtttacattttatggtgcctagtattgacaaaatgttatttccctatattaaacagatgaatccacacacctttttatttgtgggttttatttcctacagtgtacactgccatcagctttccaaatagttcatgttgtgaagccaagaatttaactgggaatatttaattgacagagtactcctcatcagcttctaaaacctgtcattctagcagtattgagatggcttgtgggagggagggatggagggagggagggagggagggagggagcagtgtgagatacttcgttgtccttttcagtgacatgtggcttcactctacaaaactcttccagttcagaaaacacatgcagacaaatgaagacaacacattttgtagcatcca

SEQ ID NO: 17483 - DNA, 4454 bp, Mus musculus
tcatgatctttataatttgagaggcctttgcttcaaaacgagaagtaatatcagtatcgtatgcttcaacaaatttagaatgacttcatggctgccctccaccatatcacacattcgaggaaccaacctatgtaaaagtaaaataagaaaggaaggaatcgaaccccctaaaattggtttcaagccaatctcatatcctatatgtctttctcaataagatattagtaaaatcaattacataactttgtcaaagttaaattatagatcaataatctatatatcttatatggcctacccattccaacttggtctacaagacgccacatcccctattatagaagagctaataaatttccatgatcacacactaataattgttttcctaattagctccttagtcctctatatcatctcgctaatattaacaacaaaactaacacatacaagcacaatagatgcacaagaagttgaaaccatttgaactattctaccagctgtaatccttatcataattgctctcccctctctacgcattctatatataatagacgaaatcaacaaccccgtattaaccgttaaaaccatagggcaccaatgatactgaagctacgaatatactgactatgaagacctatgctttgattcatatataatcccaacaaacgacctaaaacctggtgaactacgactgctagaagttgataaccgagtcgttctgccaatagaacttccaatccgtatattaatttcatctgaagacgtcctccactcatgagcagtcccctccctaggacttaaaactgatgccatcccaggccgactaaatcaagcaacagtaacatcaaaccgaccagggttattctatggccaatgctctgaaatttgtggatctaaccatagctttatgcccattgtcctagaaatggttccactaaaatatttcgaaaactgatctgcttcaataatttaatttcactatgaagctaagagcgttaaccttttaagttaaagttagagaccttaaaatctccatagtgatatgccacaactagatacatcaacatgatttatcacaattatctcatcaataattaccctatttatcttatttcaactaaaagtctcatcacaaacattcccactggcaccttcaccaaaatcactaacaaccataaaagtaaaaaccccttgagaattaaaatgaacgaaaatctatttgcctcattcattaccccaacaataataggattcccaatcgttgtagccatcattatatttccttcaatcctattcccatcctcaaaacgcctaatcaacaaccgtctccattctttccaacactgactagttaaacttattatcaaacaaataatgctaatccacacaccaaaaggacgaacatgaaccctaataattgtttccctaatcatatttattggatcaacaaatctcctaggccttttaccacatacatttacacctactacccaactatccataaatctaagtatagccattccactatgagctggagccgtaattacaggcttccgacacaaactaaaaagctcacttgcccacttccttccacaaggaactccaatttcactaattccaatacttattattattgaaacaattagcctatttattcaaccaatggcattagcagtccggcttacagctaacattactgcaggacacttattaatacacctaatcggaggagctactctagtattaataaatattagcccaccaacagctaccattacatttattattttacttctactcacaattctagaatttgcagtagcattaattcaagcctacgtattcaccctcctagtaagcctatatctacatgataatacataatgacccaccaaactcatgcatatcacatagttaatccaagtccatgaccattaactggagccttttcagccctccttctaacatcaggtctagtaatatgatttcactataattcaattacactattaacccttggcctactcaccaatatcctcacaatatatcaatgatgacgagacgtaattcgtgaaggaacctaccaaggccaccacactcctattgtacaaaaaggactacgatatggtataattctattcatcgtctcggaagtatttttctttgcaggattcttctgagcgttctatcattctagcctcgtaccaacacatgatctaggaggctgctgacctccaacaggaatttcaccacttaaccctctagaagtcccactacttaatacttcagtacttctagcatcaggtgtttcaattacatgagctcatcatagccttatagaaggtaaacgaaaccacataaatcaagccctactaattaccattatactaggactttacttcaccatcctccaagcttcagaatactttgaaacatcattctccatttcagatggtatctatggttctacattcttcatggctactggattccatggactccatgtaattattggatcaacattccttattgtttgcctactacgacaactaaaatttcacttcacatcaaaacatcacttcggatttgaagccgcagcatgatactgacattttgtagacgtagtctgacttttcctatacgtctccatttattgatgaggatcttactcccttagtataattaatataactgacttccaattagtagattctgaataaacccagaagagagtaatcaacctgtacactgttatcttcattaatattttattatccctaacgctaattctagttgcattctgactcccccaaataaatctgtactcagaaaaagcaaatccatatgaatgcggattcgaccctacaagctctgcacgtctaccattctcaataaaatttttcttggtagcaattacatttctattatttgacctagaaattgctcttctacttccactaccatgagcaattcaaacaattaaaacctctactataataattatagcctttattctagtcacaattctatctctaggcctagcatatgaatgaacacaaaaaggattagaatgaacagagtaaatggtaattagtttaaaaaaaaattaatgatttcgactcattagattatgatgatgttcataattaccaatatgccatctaccttcttcaacctcaccatagccttctcactatcacttctagggacacttatatttcgctctcacctaatatccacattactatgcctggaaggcatagtattatccttatttattataacttcagtaacttccctaaactccaactccataagctccataccaatccccatcaccatcttagttttcgcagcctgcgaagcagctgtaggactagccctactagtaaaagtttcaaacacgtacggaacagattacgtccaaaatctcaacctactacaatgctaaaaattattcttccctcactaatgctactaccactaacctgactatcaagccctaaaaaaacctgaacaaacgtaacctcatatagttttctaattagtttaaccagcctaacacttctatgacaaaccgacgaaaattataaaaacttttcaaatatattctcctcagaccccctatccacaccattaattattttaacagcctgattactgccactaatattaatagctagccaaaaccacctaaaaaaagataataacgtactacaaaaactctacatctcaatactaatcagcttacaaattctcctaatcataaccttttcagcaactgaactaattatattttatattttatttgaagcaaccttaatcccaacacttattattattacccgatgagggaaccaaactgaacgcctaaacgcagggatttatttcctattttataccctaatcggttctattccactgctaattgccctcatcttaatccaaaaccatgtaggaaccctaaacctcataattttatcattcacaacacacaccttagacgcttcatgatctaacaacttactatggttggcatgcataatagcatttcttattaaaataccattatatggagttcacctatgactaccaaaagcccatgttgaagctccaattgctgggtcaataattctagcagctattcttctaaaattaggtagttacggaataattcgcatctccattattctagacccactaacaaaatatatagcataccccttcatccttctctccctatgaggaataattataactagctcaatctgcttacgccaaacagatttaaaatcactaatcgcctactcctcagttagctagagaaagtagccaaggagctaaagggatctgcaaccctataggtggaacaacattatgagctaaccagtaccccggagctcttgactctagctgcatatatatcaaaagatggcctagtcggccatcactggaaa

SEQ ID NO: 17484 - DNA, 1510 bp, Mus musculus
tatgcgttttcaaaagtttaaagtaacattaaaatgaactgtctagctttcatcaaaaatgagagcatggccattaaaaagtactatattttttatgtttcctgaagtagcattattgtatcatagattaacatttaaaattgctataatactgtgtaaatacagagtttccaggtttgtgagggaatgtttgtggaaattttctttattgtaaaatagtgttaaatttattaaaatcttacacaatatacattccctttgttgcttttaagaaacataagaagtcactttgtcttgtgccttagggtctctggaataatgtgaaacttttaagtagcttccgctgattggctaaacaatgtctcagtattgcttgtgggtaagcataactcatgggcagcttgctttcaattctgcccataacataatgagtctaactcaagtagagttcgtgaaaaagtgttaaactgcctaaaaccacaagactctaagatgtgttccaggtggcagtgttcagatcttaatccatggagtacctctacaagaatatgtagataaaatttgttttatagaaggctttgaaacttggaaggtcataaatggaaatgtcaagaatgaatgctgaagactgagcttactaagcgtggtaggtcacgtgacagcatactcagctgcttctcatgtaaaggatttggaaacctgtgaaagaaaatgaaagttgtgtgacttaacagagttttctgactgcgttctgggcagtgaaaataaaggcttaattcgctaatgtcagctaggacttattcaaaagtatttaccgggatgcttgaagtaaaagatctgtatggctcaggagaagacctaagagttaactcgtctgcccctgaatcttcggcccaagttctgactgtacttgctgctctgattgattccctgcctcacctgagaagcttctagaacctgctaggagacttggcttctgttcccactcttatgtgattcaccgggatgccgatcccttctgctcctagttcacgttttgggggtgtgggtcagtcccttggcctccccctgcatcccgaccctgtactcttgcttgtctgtaagctccgttactgcttcagttgcaacactaagcctctctgctgtttgtttatagcaaaaggcctggcctgtcagtattaggctcccatattgtgcccaccaaaaatcaagaccgccttatatatgaagcccatcatgaagttgtgttggtttttttctgcctatcttttctttactctgtcctctcttctatctacttggtgccacttaccctgttagaatatatccttccaaagtcacatgttgaagtcctcactctagctggagaaatggctcagcagttaagagcactggctgctcttcagaggtcctgaattcaaatgccagcaaccacttgtgatgggatatgatgccattttatggtgtttctaaagtcagggcactcatatatataaaataaataaattta

SEQ ID NO: 17485 - DNA, 1176 bp, Mus musculus
gtaaccttttaggcaggcttttcagagaaatccgcattttaaaagacagcattcacggtccaaaccacgggcctggaatcagagctggtatgaaaatatgaaaagcctctttacactctgagtgtttgaaacgatccgatgagcatagcaagtgtctgccaacgctcggcggctgctggtgccgctgccgccgccgctgtttctcgcagagggctggacagagctagtcctgatttcagcacctccggcgctggacagctctctgcacgccgcaccaccgcctgcttgcttttttcccactctcgctttgcattactggagatgcatctaaattacgtcctgttcaacaacaagtagattttttttttcctgtacgggaattacagtaggcgattctctcaattaaactgcattttcttctttacggacttggctgtcaggcgtatttatcccgatctcccctccaccccctttgcaggaacgagtctttgggaacgtggtccacccagggatgtaaaactgtgcttaccgatgcatcccatacgaaatgcttatgtgatcggctctctaccttcgccattttggctcagcaacctagagaaatagtaagtaacaaagggaaaacacggctttaatgcaaaggcagggacattgtggcgagtgtttctccagggaactgcatttcaaagggggaaatagaaaaggttgcagggtggcaaaatcgggttgttctcctcagctacagtagcttggcgaattgaattctagttggtgtgcgataactaaatcctactcaattttatgtcttataacttggcatttctgtagtatagttttggagatctactctgatatcagtaatattctgcaaactttcaaataaaaataattgccaactcaaggtttattttaaaactggaatgctgttctaggggaaattgtgacaatgctgttaggagtagaaagaagaccccagccactagagctgaacacattgcagatctgcattggatatttccagcacaggttttctgagggtgtccttggatacatgtgtatttttaaatcgaattaagttttcatggagacatggttgtttggaactgtaaaatcattccttaaaagcatgtagatttttgcaaaggaagaaagaaaagaaaaattagtttctgaaag

SEQ ID NO: 17486 - DNA, 1486 bp, Mus musculus
gctcaggtccgcgtgctctccgcaccaccccacttccactttggccaaaccaaccgcacccctgaatttctccgaaaatttcctgcgggcaaggttccagcatttgagggtgctgatggattctgtgtgtttgagagcaatgccattgcctgttatgtaagcaatgaggagcttcgaggaagtacgccagaggcagcagctcaggtggtgcagtgggtcagttttgctgacagtgacatcgttcctccagctagtacctgggtgttccccaccttgggcattatgcaccacaacaaccaggccactgaaaatgcgaaagaggaggtgaagcgaatcctggggctgctggacactcacttgaagactcgaactttactggtgggcgagcgagtgacactggctgatattacagttgtctgtaccctgttgtggctctataaacaggtcttagagccttcttttcgccaggccttccccaataccaactggtggttccttacctgcattaaccagtcccagttcagggctatcttgggggaggtgaagctgtgcgagaagatggctcagtttgatgctaagaagtttgcagagagccagcctaaaaaagataccccaaggaaagataagggttcacgagaggagaaacagaaaccccaggctgagcggaaggaggaaaaaaaggcagctgccccagctcctgaggaagagatggatgagtgtgagcaggcactggctgctgagcccaaggccaaggaccctttcgctcacctgcccaagagtacctttgtgttggatgagtttaagcgtaagtactccaatgaggacagcctctctgtggcgctgccatatttttgggagcacttcggtaaagatggctggtccctgtggtatgctgagtaccgcttccctgaagagcttacccagaccttaatgagttgcaacctcatcactgggatgtttcagcgattggacaaactgaggaaggatgcctttgctagtgttatcctctttggaaccaacaacagcagctccatttctggtgtttgggtcttccgaggccaagagcttgcctttctgctgagtccagattggcaggtggactatgagtcgtatacatggcggaaactggatcctgggaaaaaggaaacccagaccctggttcgagagtacttttcctgggaggggaccttctagcatgtgggcaaagccgtcaatcaaggcaagatcttcaagtgaacaagtcttgccagtcgcctagctgcctgcacctacccttcaagggagatggggatcattaaaggaaactgaacattgaaaaaaaaaataatgacagattgataggaatgcatccaaatggcaggagaggctatgaggaagttagagaatcagagctaggcaatggtgtaatcagaatatattatatgaaaataaaatctccttttataacaaaataaaaatgtacaacaaaaccaacaccaaatggttg

SEQ ID NO: 17487 - DNA, 1106 bp, Mus musculus
ggagagggagcccttgcctatggcccagggacttagatagaaaccaacacaattggacagggtacacacacacacacacacacacacacacacacacacacacaagaaataagtaattatagagtagtattctgggataaatcctataagaaagtgaacttgtagaacactataagagggagtataattaatttgttttacataatatgctttttatataagttcgacacggtagatctcgggaagctgctgtgaatacggaaactccaacgttgggggtttatttaatagacaaagtaagaaacaaactcaagatggcggaggtggacctggagtcggatcagattcgactgaagtggatccgtaaggaaggtttcttcaccgtgcctccagaacacaggctgggaagatgctgaagcgttaaggtgtttgagaagctgaaccggattggcgagggcacctacggcatcgtgtgtcgggccagggatacccagacagatgaaattacctccctgaagaaggtgcggatggacaaagagaaggatggcatccccatcagcagcctgcgtgagatcacactgctcttgcgtctctgccatccaaacattgtggagctgaaggaggtggttgtgggcaaccacctggagagcatcttcctggtcatgggttactgcgaacaagatctggccagcctattggaaactatgccaacacccttctcgatggcccaggttaaatgcatcatgctacaggtgcttcgtggccttcagtacctgcacatccacagggacctgaaggtgtccaacttgctcatgacagacaagggctgtgtaaagacagacagcagcttgtttgtcctcactgagtgatggatcgtcttttctcctctcccccctgctgcagctgattttggcctggcttgggcctatggtgttccagtaaagccaatgactcccaaggttgttaccctctggtaccgagccccagagctgctgcttggaactaccacccagactaccagcattgacatgtggtaggcatggtttctgctcccagggcctcaagtcttctggccctggaggtcagccctggtcagggggagcagg

SEQ ID NO: 17488 - DNA, 1149 bp, Mus musculus
atctcattttgcttattttgatttccatctcttacagaaaagatacttgatgaaaatatttcttaaaattagatgagtttgaaatttctatttctattcatctgacagaattcaagagactctaatcaatgtaaattaatatgttaggctacttatatataatatatttacatatgtatatatattatatattagtatatgtatgatcaagagtagtctcagtaaatttttattgatatgatcaggtaagtttcagatgtcagaataaggaagtaatatactttaaactactgaaataaaagcacatagcaaatagctaagttatttttattttatttttccccctatgatagaacaagtaagaagtttgcgacaaagcactattgccaagcgttcaaatgcagcaactctaagcacaaaaaagccatctgggaagaccttatctacctctaaagtaggggtgaagccagcagaaagatgtcagggtaaagaagaagtttatgcctcactgaaatctgaacaccctaaggagagtagaaggagtggccggcatgctgaacagatggacgtggcgccagaagtctcagcatcttcagttgattcttcagtgtcgtcttgtgctggaatgaaggaggaggctgagtttgatcccaaacatgcatgcaataatcagggtgaagtgaacgtgccatctcctgagttagattgtccacttctctcagagactagtgctagtgtggaagagaagaacattgaggctctgatggaatgtaaagctaagactaacagtagcccgttatttaagtttccagttagagaagatgagcagagtgatcttgtttcgggtgaactgaatgacaccattgaaggaaaggatgcagggggaaaacctgatcaagaatcagaggaggtgaagtttccctgcgaaggtgaccagacggccgaggaacccgaatcttctgatgtgtctagtgactctgcttgtgccaataaaaataaggcagaaaagaatgaaggggcagaatgtcatttggaattgaagaatactgtggatattgttgataaacctgagaactcacctcagagaaatgagttggaaacactgggctatggtgaggacacggagtctaatgatgctcggttacagag

SEQ ID NO: 17489 - DNA, 1228 bp, Mus musculus
tctgtgttatttgtgaataattttaatgctttgtaaataaaacaaggctactctatggtttttaatagttgtggaccataatttaagtaattgaattttagctattttatgtggactcactgtaaaagcattgttttattctttatgaaaatgttatggttaaaacacagtcttatggttgaaacaattctttcagatatgtcaaaacaatgaactatataattctaaaaataaaaaatttagtaagacatttagtaggatttctggtaagatattatcctatatgcatggtaaagaaaggtcattcagtaaaaatttgatccatgtttccaaatgtatgttctaaaaaacagtgagggtttttttgaacaacaaattcagaagtgtgttcttagattcaaaattattaagataatttggtattaggtgattattttcaattgatagctttatttcttatggtattttttttgtctttctatagggttgaaagacacacagaagtcttcatggatatagttgatacatttaatcatttaattcctactgaacacttagatgatgccctatttctaggatccaacctggagaatgaagtctgtgaggattttagtacaagtcaaaatgtcttagaggactcgctgaagaacatgctcagcgataaggatcctatgctaggatctgcaagtaaccagttctgtttgcctgttttggatagcaatgatcccaatttccagatgccttgttcaacaggtaattcttactttttttttttttttaagtctgcaatttaaaataaagacttttcagcagcatcttttttccttttcttttttaagaatgagtgtagtgcatttagggttctttcctttaaatttagagtctcttttctaggcatcagtttagagaatttcaactacattttcttctaaacagtgtacagagttattgtcaaggatgttatagatgtaggtagagtgaccaggtaacttggcacatcagagtgggatatttgtgaggaggaaaggggttgctattaataattatgtctttagaacatgtgaaaattgggactcatgctggaaaaagaggttgtctggcaaatgggacagtgccatacagggcctgctagagtgaggaatgaaagctgaggtgacacgtcttcagctttcatcgttttcttggttctaatcacagagactttgatactttgtatgtctattgcaaa

SEQ ID NO: 17490 - DNA, 1140 bp, Mus musculus
tctgctttttgaccagtgtggttgttaatctacattttgctgagatacatatagctggggggaggaggttgttttgacctagactcaatcatttataggataaaagttaaatcaaaccacttagcataacatttagaaatctcaagtgttctaggtgggccctttggtcttcatttccttactaccagaaatagcatccttctaacttctgtcatgatcaaaaagtcctttgtctttttccttccttccagaaagcggcgtggagcttttaacagcaagcaacttttgtatctggagaagtaccgtccgaaaatgcggctccgcttcaaggattccaatggtcatagaaacaactgttgtattcaataaaactggggtgcctgatgccattgccttggaagtggaacttcagatgggacctgatttgtcatgcatattacccaatgtgtcggcttactgaataagtctactgcagctccacaggaatactgaaaaaccagtcttaccaggccacaagtttgacagaattgcaacctctatatttgggctatgatcaacatgtttggacacttagcaaaagatttttgctggtcagcatttaaaatgtgcttattatttgtaccaattgacctttcctaaaataaggtattgagttatgtcattaaatgtactcctgtgccagaatattattagtctataaggaatttagaaggattaggtgccaaaatacccagcacaatacttgtatatttttagcatcatacagaaccaaaattgcaggaactgagaactctagaccatccatggtgtattccttcagtcatttcaaacactgcagggcttctctcgttatctgcctgctcactctgtttacatctcccacacttatgccagaatacgtcaggtttgcttagccatcctttattttttttatttttttttttaactaagtcttgcgctgattatttaatatgtctgtctcattttgttttgttttgggaaacctctgtttgaaaatcaactttgttacagaagcacatatcttcaacaatgtctccagacaaaaagccttatagttaatttaatgtttgcactcagaagtgcaacctaacagggagggcctgaaaaagaaacgagagg

SEQ ID NO: 17491 - DNA, 1140 bp, Mus musculus; identical to SEQ ID NO: 17490

SEQ ID NO: 17492 - DNA, 1168 bp, Mus musculus
gctcctcgggcagctcactgcatggtcgtctggtgcccccgccgcctgcatccccgccgccgccccgcgacgcccaccgccgcctgccctgccgccgccgcctgcgccgcctcgggaccggctgtatgattaggccacaatcttcaatgagtagacatattcctgtgagtaccgcgggcccggcctttgttagagcgagcgaccgaggagggaaaggagggtggccgggcgaccgaaacgccggcggcggggcccggacccggagcgaccggcagggcagcccagcggctttgtgcgcgtgccaccctgcggcctttgttccgagaagccgcgcgggcgtcgtggacgtggccggggcggggcggggctgcggggggaccgggaccgggcgcccggggcctcccaagatggcctcggtggccgcccgcgctcgccaccgtgaacccgtgattgcggacctcgcgactgtgcgcgccgctcaagcccgggcttgccgatcgccgccgggcttcggtagtggcgacccggtcggcggagggggactctgactcggccccgaggcgggctgcgcgtggggcggtccgctcttgggctggagcaacaggagctgctgggcagaactgcgcggctcctgttgagcgagcagccctgcaccattccaccgctggcgagctgaaatttccacggtgtcggaacggtctgtgcggtgaccagaggtctggattccggagcttaggggtcatgaatcctatcctggcttgctttttttaattattattattattttgctgtttgcttcgtgccggctaaaacggttggaaaaccagaaaatcgcgatctgttcccggaaggaaacagcgcttgcacacgcgctagattgggcgcgttacctgaaacctgagtgtatttggaacagaattggataaagcagatgatcccacagactggtttgattctagagtctgacagactgaagctaatgctacacacatacacacacacaaatgatccttttttttttttttttttttttttgcttatggtgcatgcaattaaaatgggacgatctcgtcgtgtatcttggctgcctatcatgttgaggttttgcctgtgagggagtgggaggatattattaagaaggatttcggtggtctccactgttttaaca

SEQ ID NO: 17493 - DNA, 1168 bp, Mus musculus; identical to SEQ ID NO: 17492

SEQ ID NO: 17494 - DNA, 1219 bp, Mus musculus
atatagatatagatatagatatagatagatatagatatatagatgtgtgtgtgtgtatatgtgtgtgtgtgtgtgtgtggttgtgtgtgtgtgtggttgtatggttgtgtgtatacatatatgcatgcatacgtacatacatacaatacacatatacaccacatatacacacatatattacacacatatacacacggggggggagagaaagagagaaaggggtgcaaatttagaaatctaggtacattactttttaaattaagaaatgcctgatacctttcttgtgtatttttgtttacagcaaacaactctctgaattaagaacaagttaagatttgattcacggctacctgggggttggttgagagggacggtgggatcccggctggagtgtggcactgccactgcgcagagacgaagcgggcagtcagaaaatgggtaagaagagtcgagtgaaaactcagaaatcagatactggggctacagccactgtgtcaccaaaggaaattttgaacctgacaagtgagctgttgcagaaatgtagcagtcctgcacccggccctgggaaagaatgggaagagtacacgcagatccgggctctggttgagaaaatacggaagaagcaaaaaggtctgtctgttacttttgatggaaaaagagacaattacttccctgatgtaatgaaatgggcctctgaaaacggggcttctgtcgagggttttgaaatggttaacttcagagaagagggctttggtttgagagcaacaagagacatcaaagcagaagaattatttttatgggtcccacaaaagttactaatgactgttgaatctgctaagaatttagtattggggcccctgtattcccaagaccgaattctctaagctatgggaaacattgcactggccttttatctgctatgcgagtgagccagccccaactctttctggcagccatacattcagaccctccccagtgaatatgacacccctctctacttcgaagaaaaggaagtacgatgtcttcagtcaacacaagccatccatgatgtcttcagccagtataaaaacacagcacgtcagtacggctatttctataaagtcatccagacccatcctcatgccaacaaactgcccttgaaggagtctttcacttacgaggactacaggtgggccgtctctcagttatgactcggcaaaaccaaattcctacagaggat

SEQ ID NO: 17495 - DNA, 1132 bp, Mus musculus
tcacagcctggttttgtgaatgcagacggcagtttcccagtgaagaggcggtagaaaagcatgttttctcggcaaacacaatgtgttataagtgtgtggtctgtggaaaggtttgtgaagattcgggggtcatgcgtttacacatgagccggtttcatggaggggcgcatttaaataactttctattttggtgtcggacgtgcaaaaaggagttagtaaagaaagatgccatcatggcacacattactgagtttcatagtgggcatagatatttttatgagatggatgaggtagaggaggaagaggaggaggccatgccgtcatcctctgtggagagccatttgaatactgacaaacctccttcacccattgctgttgttgatcactgcccggccaacagtcctcccaggggcaggtggcagtgccgcatctgtgaggacatgtttgaatcccaggagtgtgtgaagcagcactgcatgtccttgacaagccaccggtttcacagatacagctgtgcccactgcagaaagactttccataaagtggaaactctgtaccgacattgccaggacgagcatgacagtgagatcatgatgaagtacttctgtgggctttgtgatctcatttttaacaaggaagaagaatttctgagtcactataaggaacaccacagcatagattatgtgtttgtgtcagaaaaaactaaaacctcaattaaaactgaaggcgattttaaaatagtagagaccagtagtttactaagctgtggctgtcatgagagttacatgtgtaaaatcaacagaaaggaagactatgaccgatgccttccagtcctgctggagaaaggtaggctgtggtttcgctgcagctcgtgctcagccacagcacagaatgtgaccgacattaacactcacgtctgccaagtgcacagaaaagagaaaagtgaggaggagcagcagtatgtgatcaagtgtggcatctgcaccaaggcattccagaacacggagagcgctcagcagcacttccacaggaagcacgcggccctccagaaacccaccgcgaccccagggggagccaacagaagcagcacatgccagctggctgctagtgcctcacatgctgagaaaaacct

SEQ ID NO: 17496 - DNA, 1193 bp, Mus musculus
tatactattaatggaatatagcattgtcttaagggtttatgtggttcctgtttatcatagtggatgaccttttctgtgatgctcacgctttgtaattcattagaaaacccttcctactttcctacacatattcagcagcctacttaacctacatttcttcttttttgtttttgagacaggctcttaccacatatacggagtaggcccggaacatgattagtagaccaggttggccttgaacccatagagatatgcttgtctctgtttggcttctgactgctggaagtaaaggcgtgtgctactaggccaggctgctgcttttcatttgtgccatatatattgaaggcacgaggctcccaccttggaagatgttactttgtcagataattttagggtctgtattagtcctgtttgtcttatttgtagaccaaacaggaactagtttatcaagattgtttagcagatataactgaattgtatctagagttaatatttacttaataagttaatattgtccacagaattttttactttgactttcttaggttcctacaaggggtctctaaaatgtctctcaaactaactcgagataaacagacttttgtagcttgtattcagtgctatacaaaggggtagtagactttagcccatgactggagcagtgcaggtttcctctgagaaagggctaaccacccagactctactggggcaagtttgcacatgtctttgtgcagcattgggcctgcttcagctcgtttgttcttttccatcttgccctgaattagatgctacatatcacatgatttatgagatactcttgttgtttaaaaacaaaacaaaataaataatgcttggagatgtgcttttggaaactgttttggcacgcccacctaatttatttgtatcaatccccgctttatattaaacggcaacaaaaaagcacagaaaatttagcactttaataattttgacattattgtacagctcttaagtattttcaagacagcactactctcgtcttagatgtttatgttgttcattaatgaagtaaaagtaacattgcttgaccactaattgacaaacccaagcaactccaaagaattgcgtttttctcaaagtgaaaaatgccgggaaatcaccaaattggtgatgagtcagacaacctaatagcagtgcttggcggctgagctggt

SEQ ID NO: 17497 - DNA, 1187 bp, Mus musculus
atgggggaaagtgccaagaaacaacgaggaacaaggctgagaattgcagaggcagctgaggtagatgagaagattaaatcaacagaacaccgacctgtgctttctccagagcactattcgcattttctgagtttgctgtctctgtccgtttcctctttctttttctaagaacttggttgtcggtgatgtcatctgtctgcaagatcttctgcattttctcaattagtcagcccaggctttccggaacggcgatggcagaaacgcccatgtaggtgccgctgttctgcatgcggttctcgcttcttaaaaacaaaaacaaaacacagggggcctcagcctgctgccggctcaggtgagcgcctttcacggaaggtgccatgtggaaggggccatgttgttgtctttcttactggccaacttcccgcacatgtttacttgactcaaaaaaatccagcttggtgctggagacgtggctcagtggttaagagcactgactgctcttccagaggtcctgagttcaattcccagcaaccacatggcggctcacagcctgggatctgaagtcctcacagatgtgtcttacgacggctatggtatactcacatacataaaataaataagtcttttttgttttaaagattttatttattttatatatgtaagtacactgtagctgtctttaggcacaccagaagagggcatcagatcccattacagatggttgtgagccaccatgtggttgctgggaattgaactcaggacctctagaagagcagtcagtgctcctaacctcagagccatctccccagccctaaataaataaataaataaataaatcttaaaaggaaaaaaaaatctattgcaaggcaggggattgatacacagtagcaggtcatactttaagaaacaaaagaacccattcagctttgttaccgccctcaagctgctcatgtggtcaggtgcggctagttggctttaaaaacttcaaacagtgtaagaacactttccatctgcccttcttgtcaagtagccatgaagaatctacaggttttaaaaattctaggtgtatgtaaacatcatcacacagaactgaaattatgcacttctaggaaaatgtattaataatagttgacaacatcaggatggagggtaaacatattcccaagagaccaataagagttgcttag

SEQ ID NO: 17498 - DNA, 1138 bp, Mus musculus
cccgaggaaactcagactagaagggacatgtgccatcatagtaacagctccaggtgaaaccgcgtagtctcagcgttacgttgactaggagaaaactccaatcatttccactaaagtcaggaacaagtcgaggatgcctgctcctccactcccccttagtatagccctggagttcttagctagagcagcaagacgagagaagtgaaaaggttacggattgggaaggaagatgtcagagcaccgtccgtattgggaagtgtcatgattctgtacataggagactttgtatcctttgtatcctgccaaacactttcaacaaagttggcaggatacaaagttaactttcagagatcagtagctttcctggtaccaatattcagatataccaagaaagaaattagggcaacaaccccatttaaagtactttcaaaataaaataaaataaaataaaacaaaatactttggaatgcacttaactaaggaagcgaagggcctctacaaggaaaatatagaaacattgaagaaagaagtcgacgaagaggctaggagtagtggctagccttgcactacgtacctacttggagattaatgtgtatagaggtcctgactcctttaaacttatgtcatcaagtttatcaatcttgttcagatggctcctcatggcctgtctttcatgatctgttttttccctcagactgccttgttatcttataatctgttgacatcacaagatctgatgtaacgactcagtgtccacctgaaaggccctggcctttttttttttttttaaattgaagtgatttttatatactgtaagaattttgaaaagaaagtttaatacgtaatgctttcatttaaactgtaatcttcctaaaaaacctgtgttaagtatatatggtattatatactggtttgtgttttaagcagttcctcttttagctgataattgtcattcagttccaatgcctggatttgtgtggtgtttgtagtcacatttgtgcccaggggtattacatggtgaccttatgagaaatgatgagggacagtttttatgcataccatacacatctgtgctaggtgagggcccagtgctgtgctttgctgagtaaaatgttcacatagatttaaacatttgttg

SEQ ID NO: 17499 - DNA, 1191 bp, Mus musculus
gttactaaatcccagtcaaacggcctgaaggggctgctgagatgtctcagtggttaagagcactgcctactcttccgaaagtcctgagttcaaatcccagcaaccacatggtggttcacaaccacccgtaatgagatctgacgccctcttctggtgtgtctgaagtcagctacagtgtacttatgtataatgataaataagtctttaaaaaaaaagtggtctaaagaggcagaattatcttctcttacttcagagctggcagctctttcttctgaatgggaaatgaggttcctggaatataaagtttagggctttgtttcaatgaaataacaaaagtttgttgtgtgtatatgtgtctttaatgaagaagttattcttgacttaataactgcttgaagtgacagccgatgtttgcgaaagccattagcaaaagcgattttctacaattttgtcaaggaacagaggtaatgaaaatggaaccttaaggactgttaaaggcacaactttccttagtgtcagctgggaacaattgagcacctaatgttttaaaaaatgttggtgcttttcatctctggctgttgttttgtaatgaaaacagtgaattttttttttttttaaagggatgtggtggaaagacatgagggtaccaccgagtaccagaacactgcttacaaagttcagaaaggacagagaagagaatcaggcggactttgtctctttagggctgttccgagctggctgtcatacaatctcactgtttccctgtagttagtcttctgtccttggatcaaataagcaaaagggggtgacatcacctaatatctaaaatatcacaaatgcttatttttttccaccaatacagctgtacacattagcactgctatgtttcctgtttctcacaggaactaacagaagcccccaggagccaggcaattttctcaaggtcacatggctgatatccaatatacactctgccaaaccatatgcaatttcagatttctacaagacaacatagatggtagatggagcatgctgtctgcaaagggtctgtttttatgtctcagggtttatacaagatgtggctgtaacccagatcttctttctaacaggaaccatagcacacctggttctgaagtacttagaatcaaggtctctcttatgacattgagtaggtgggtaaatgcaggtaaa

SEQ ID NO: 17500 - DNA, 1195 bp, Mus musculus
accttcctaatgttgtgaccctttaatacagttcctcatattgtggtgaaccccaactttatgttgtggtaaacccaaccataaaattacttttgttgctacttcataactgtaattttgctcctgttatgaatcataacgtaaatgtctgggttttctgatggtcttaggtgacccctgttaaaaggtcgtttgacccccaaaggagtcgagagccactttagggtattagtgaaattgagtgtttttgacatagacttttactgtgtagcctaggctggctggaacgcagtatccagctcattgtggttccagactcacaggtgctgggattttagtgtttaatgtcatgctggtttgaccctgtgcccctaatcatgccgcctctcaagtgtgaaacaggcatggtcaactgaggcacatcacccatggtttagaactgttgggtgacttctctcagttttaactcactggaatgtgtgtctggtatcctcagtgcagggaacgtttacatctgccaggagattgagtgctgtcttcagtgaaaaacagacaagagacctcagtatgcggttcacaggagaaccagcaacagcctgtgagccctgaaggcaggggcagtgttattttgttcattcagacagtaacgtggccgggcgtggtggcgcacgcctttaatcccagcactcgggaggcagaggcaggcggatttctgagttcgaggccagcctggtctacaaagtgagctccaggacagccagggcgacacagagaaaccctgtctcgaaaaaccaaaaaaaaaaaaaaaccaaaaaaaaaaaccaaaaaaaaaaaaaacaaaaacaaaaacaaaaaaaaaaaccaaaaaacagacagtaacgtgatcctcacagctacccagcctgtagcccggatccgtgaccacaagcttactgcctacagcttagtacacacttaccgagcattctataaaggttgtctgtcctcctccttagatgccatctttaaagaattgagtttttaaaaaagatttttttaacgtgtgtcataagagatgttttattaaacagtcgtaagttcaggcaaggatgaaggggtcgagttactttttcttacttgcagtcaagtgtcagtatgtgctgttttatacaattcactatgtgatgtgggcctttgaaaacaggagaccggctct

SEQ ID NO: 17501 - DNA, 2042 bp, Mus musculus
tcttcctattaactccctgctagcaccacagcagatggggtatttcctaatactacctaaatagaccaattagaatttttaataacatggaaaaatgggggaggggtgagtgtggttgataatattctttcacagttcttgaagaaataataatgataatttgtaattcataaaatgagttaggtaacttcctgagaatattttcaagcctatatgtatatttttttaaaaatcattttcgtatcggtaattcatatagcaatattaggatttaactttttaaaattatttttattttttttattttatttttttcggaaaaggcttcaaaggagctgctctaggagaacccagcgtcccatttttcatgttatttatgtgagctataaaggaatcaaagtgttttaattggtagttttcactgaagcagactggccctttttactagttaggtcaaggcagcaaagagctcttgggacaagctgtcttttatcatccctgccttttaaaaggtcgccgatgtgtttgagagttctgtgtcctttaagagaggactgtggctcctttatctggctgcccgttgcctctgggatgtgtgcgcgttacccaggctctctgaaggtcctttctagcctgttttttcctgagggcccctttctcctcagacagattaggccactggctattgtgagttggcttcactgaaaatcacagtttacaggtaggtaccgaggcgtggtgtagggaggagtaactctcagcccttcttagaaggaacaaccatcgtaacaaaagactaagaagaaataggatgaacgcatgaacagattccacggttgcacgcgtgatgagagccgtctgggagtgggcagttctgggcaggagctttgattccagttgatctaggtattcaaaagagaagcgtacattttttaaatgacaggacaaacataaaccactgagtctcaaggggcgggacctcagaaacagcacctgaggggcagacagaggctcattattgaagtttgttcttgtttatcctcagttaccatcccaagggcagacgtcttctctctggttgaatcaggaaggagggtacttctatcttataactccatgttctgctcttagggatttaaataaaggaaggctgagattctttatggttttgcttcccactgatcctaattttgtgtaatggtgaaagtataacaacgtaaaaacagaattctaggcctttaggcccaggcttgggaatgtggcctttgtaaaggtatgctaatcataaaagagatagcgacattcctctacccacccgcttcctgggttcaaagagtgctcattcaaagaaagtcaccctggccattaccagaacctgcaatgcaaatgtgctattgttaggggctcttagaagctgtcttgagagttaacaattaccaggtattccttgtgactcttgtaactttatacttccttgtgactcttaactggtatctttggtatcttccaacaaagccctccccacttccttgagtttcggtttcttcctttaaatacccccttacccagctactcggggcgccacagtcctctacccctgcgtggtgtatgaccgtgggcccgagagcgctcttgaataaaaatcctcttgcaatttgcaacaagaccgttttctcgttggtgattttggggtgtcgcctctcctgagtcagaacgtgggggagtcctcacgttgtgggtctttcaatggccttcagagctgctgctgctgctgctgctgctgctgctgctgctgctgctgctgctgcttcttcttcttcttcttcttcttcttcttcttcttcttcttctccttctcctcctcctcctcctcctcctcctcctcctcctcctcctccttttccttcttcttctccccctcttccttctccttctcctcctccttcttcttctccttcttcttcttcttcttttttttttttttttggttattttgagacagggtttctctgtgcagccctggctgtcctggaactcactct

SEQ ID NO: 17502 - DNA, 1154 bp, Mus musculus
cttcgtcaaacagaagttcagtagtccattacaaatccaaggatgaaagcccaaactgtatcttgtatgttttgtgacttagcacgctgttctgcccatgaagatgtctgtgaatctgggtcctcttgtttctcttatggtaccagcatgacatcattgtgctacctcagtttggggggcctggattctctgcctttggggattttgttgtagttgtttgtttatcttttaaagattgtaaaattggtgtgttctatatttaaaatttctttggaagcttttaacttggacacagataagtcaaatatgaaagcctgcttggaattctattttttctctttaaaaggggatgcatatttagtaatatatttagcacaacaagaagaattacagtatccaggaaaatgggatgtgaggacttagcacatagtagacgtttaccctccgcacttccttccttcctaatggtctgatgcttccgttatatttagatatctgacatccatgtcactggagagtcagaggacatgtctgcgaaagaaaggctgctcctgtggacacagcaggcgacagaaggctatgctggggtgcggtgtgaaaacttcactacctgctggagagatgggaaactattcaatgccatcattcataaatacaggtacagaatgtgtccggccttgtcgcacgcaaacacaagtcattccttcatttctggcgttttcaatcgtatgctcctgttgaaggggcactgcgtgtgcgtaagagaggaaagggccagataaaacgaaagacagcgctggcccacagctgaatcagtactctaaactgtaacacacacacacacacacacacacacacacacacacacacacacacacacagagagagagagagagagagacagacagagacgggcagagcagcagagtggtgttatatctgtatatctggaatatatatatatatatatatatacacatacatatatatgtatgcacacacacacacacacacacacacacacacaccccttagcagaaagtaagctcagatgcctataatctgcaggtcagtgatctagtttatctacaggttacccatgagcagacaggcaaaggttcatagttcacaagcttaacaaggcgtgaaactcc

SEQ ID NO: 17503 - DNA, 1655 bp, Mus musculus
tcccattacagatggttgtgagccaccatgtggttgctgggaattgaactcaggacctctggaagagcagtcagtgatcttaaccactgagccatctctccagcccaattaacaaaaaatttttacctgctttttccctttagattttggtttaatttaatggttaattgatagaatataattcacatttttgtgattattaaacagaataataatacattacttcctttgggcatttcagtgatgatttggtattttaaatgactttagggaaatttgcttggtaatttttaagttttaaaattcacattctaagatttctgttttaaggttacgtccttagggtttgtgctaataggaaccactggtttgtctcagtaagaacaaagctggtgtagtgaagcttgcacgagagcttcctggggagcggaagttacttacacgctgtgtccttccacagaggagcaagaggaatctgtgtataatctttacatctcggaagtgcgaaacattcggctccgcctggagagctgtgaagacaggttgattcggcagatccggactcccctggaaagagatgatttacatgaaagcatgctcaggatcacggagcaggaggtaagagttacacacgtgttagcaaagccagagtcatttcctcttagagaccctgaatgtcaccttctgatttccccgcatgagactgtgacttcagttcagttgtgcatttcttactggatgtgaactaagatcccatgactgaggtctgcctctgaggtagtaaacagagaggcaccctggtgggcttcaggcagaagtcattatacacccgctggttacagagttagagatttaggtcaaaggacaatgcagtaacgtcattactggttatcaagctgaattggtgtgcttctgtttacttggtagaggaaaaggttagacaggtgcttatattggtaataaactacaaaatgtgtttttaagctgctctaagaaccatgcccattgcagagacaaagataacctccgtttgttttctgtactagaaactgaagaaagagctggatcggcttaaagatgacttgggaacgatcacaaataagtgtgaagagtttttcagccaagcggctgactcgccgtctgtccccgctctccgatcagagctcagcgtggtcattcagagcttgagtcagatctactctatgtcttccacgtacatagagaagtatggcagcaatcagtccttaccccgtcccctctctcagtgcttctgcgggcgatccatttatcttaagaaactagattgatgatgtttctccatgttttgggggggaggggctacctggaaactccctttttgtagtttgatgatatttctccatgggtgagggggctacctgtaaactccctttttggggtttccgctcatgcttggcataacctattggaacctaggaacctattggcatctgtgtaacagcctcctaggggtggggtattgggtggtgtctattaggaaaagaatcagctgactgccacatggacaggaggccagtcagtgtcccatgtcatgagttttaatgaccctgtaagtctacagtgtgtgtcgggggaagacattgaacagcatgaactagtatttatttctccttaaa

SEQ ID NO: 17504 - DNA, 2195 bp, Mus musculus
gatctattgccatgaggagacatcaggaccaaggtaatttataaaggaaatcttttagttgggggcttgcttacagtgtcagatggtgactccatgatcatcatggtgaggggtatggcagcaggcaggcaggcatggcactggagagatagctgagagcttacatttaatccacaagcccaagacagagagagagcaacccgacctgggctgttgaaacctcaaagcccaaaccccagtgacacatttgcttcaacaaagccaccctctaatccttcccaaacagtcccaccaactggaaccaagcatttaaatatatgtcatacaatgatgaacaaattgtaaccgtgggtaaacagtgtgtttctgtatgacttgttgatacattatatcatgatgtccattgattcatgtatttcagcaatggcgatcagaagtagatgagaagagagaggtgttccatgcattggaagacgagttgcagaaagcaaaagccatcagcgatgagatgttcaagacacacaaagaacgggaccttgactttgactggcacaaagaaaaggcagaccagcttgtcgaaaggtggcagagcgttcacgtccagatcgacaacaggtgggtcacctttctgttcagtgcacatgtaggtgggagtccctttgtgtacagagggcaaattccaaacttaccaggtgttaagtgaccttccatagctaatgtgtgagctgtaggattattccctaattccatttctttcttacagactctcttttgcaaaacacgtaacatgaaagaaacattctcctttctttttaagatttattttattttatgtgcgtgggtgtcttgcctgcacgtgtgcatgcttgtgttccgcatgcataccaggtactcgaagaggcaggaagaaggcattggatcttctggaactggagttacagtcagtagtgagcttctatatggatgctgggaaccaaacttaagtcctatggagagcagccagtgctcctaattgctgagatgtcactacctccagaaaaatgaccttttcaactgtgcacaactaaaaattctgatttatcctgatatttgtataatctgtcttttaaaaagatagtagtatactgctctaaaagttattaccaacttacaatgttcaaataaccatgagtttatgaaataaatcataagcttatttcttgggctctacatagcaataagctactcaggatccgttgattgactgtaatgaaggtcacttgccctgcgttttcagctttagccttagagccatagtaaaacagcaccaacaaacttcatagctcctgggacaggctatctctgttcacctggacaccacatggggcaggtgctgctggaattgtgttttaggctgctgccaggtatctgccctgttgtgcttggtggctcttccctgcccttcccctctcctgctggaatgtgactattccattgctgttcttgtaggctccgggacttagaaggaatcgggaagtccctgaagcactacagggactcctaccaccctctcgatgactggatccagcacattgaaacgacccagagaaaaattcaggaaaatcagccagaaaacagcaaagccctggccctgcagctgaaccaacagaaggtacttgaaactgagagtctgtctgaatttggtcggcctcaagcctcacctttctctcctgtcttggaatcaaaggcagttgcttagaccaatgtgaggaatgatgatgcatgtgagaattctataccttaaacctgcctgcatttacttttactttccagaagtcatttataaaagcatagatattgaaaagtgtgttagggtagtttccacagacttcattttctgggtttcataggctgggtctaatttttcttgataatatgctggcagcatagttttatacttgctaaattaataaacatggccagaggtaatagatagaatcccggctagtggcgattggtgggaagttggatggtttaaggttttatcattagcagccagtaatgtctaagagtttgcatctggagtgggtataagggacagcaccacgtctgctctgcaaacttctcatttctgccctgaaagcctcccaagggtagatcgtttattaatcttccctggaagtttgttatttatctataagtcaaggcacgtgtaa

SEQ ID NO: 17505 - DNA, 1901 bp, Mus musculus
ggctgagtgccctgttaagccacgatgagttgaggcagagtcaggggcgttttagtgatacaagtaccccacagaacacaggatatttatgcgaagcctctactttgtcacccagtgaccagagagtgttggctgatcagagcacaagagaaaagtttcaagaccagttcctaggaatcgcagctatcagcgtcagcctccagggggcgccctgtggacagaagcctgtagatactgagtgtagcagttctcaagtacactatcacagtgaggaatccatgtcagatgcttctgctgagagtggagccactcggcagacagatgagtcagagaaaactgggtctaaggtggaagacaactcctgtaccatggtccctgggggtggttcccgcaatgacaacacatcagattgtggcccactgtcacataaaggagccattgatgctggtgactatgagacgtcactgctggccggccagcagagcgacacggcaacagacagtgacagtgatgactatttctatgacacccccttgtttgaagatgaggaccatgactctctaatccttcaaggtgacgaccgtgactgtttgcaacccgaggactatgacacctccttgcaggaggaaaatgacaggacccctcctcctgatgacattttttatgatgttatgaaagagaaggaaaatcccgagtttcctcatggaggaatggatgagagcttaggtgtggagaacaaagtatgttgccctcagggctttcctgtaggtattgagaaacctgagttgtacttagctggcgagaaagagtttaattctggtggctcagaacagttagtggagtctgtgtctgaaagtgagaacccgcctggcctttgggatagtgagtctgactcgttgactgagggtgagattataggaaggaaagagaggttaggagcttcgttaacacctgatggtcattggagaggggacagagaagagtgtgacaccagccgagaaagccagtctgataccgatggggtaggctccatacaaagtagcgaaagctacaggccttatatgagcgatggtagcgacttggatgaggaagacaacgggggccgcagcagtgaggacagtggagacgggcgaggaggacaaggagtagcagatgagggtggagagccccagtaccaagctgaccctacccagttgtacactgctatcaggaaagaacacgggggtgaaacccaaaatgtcagtgacatgatccccctggacaaaacgcacagttatagtccgttagaaacgcagcatggtgcaggtgttttccagccagagtcagctggtaggggaggttgggacacagaaagaagcagccatccagaacttaccactgaagctgatgaggaagacgaagcaagtctgtccactcacatggcaactaaaggtgtgtcgctgtctaatgccgaaggcactgcctcagaagaaatcaggttggttcaagggccagactctacaggcattctaaaagctgaagacctcgagaatgtatcgccagaaatcagcccatcttctgacaacattgtccgttctgaagctgagttaggaggaggagcttctgaggatggccatttgtcatttacaggaagtgacagggatcagcagggacctggaagaggtctggttaaaggtagagatggccaaagcgataagctggtagatgagacgtccattcgggaaatgggctttcagaaagaaggggtgttgatgagcagcccagaggaaggaggagaagaagaaagggatctcgaacccttcccgaatggaagtgcgacagagagcctcaacatgggtaagagtcaggttccccctctactgacacacaccgaggaacttagccacagaggggctccgcac

SEQ ID NO: 17506 - DNA, 1282 bp, Mus musculus
tccctagactctgtgtaaagttgggtctggtaacacatatctgtagttactgatgcttctgtgggggaaatagggggtggagacaggagttggcagttaccatggtaccttgtggctgactggctaggaggaagcagtgaacaatgaaagagaagggcccagtctcaaataaagcagaaggcaagaaacaacacctgaggtggtcctctgatctccacactggtgccctggcacacacatgcgcgcacgcgcacacaaacccacaccacatacacagatgcaaaatgtgaaaatcacctattaccaaatgatgaataagtagattttttttatgtatacataaaaagtatactcttatagtgctgatagaagaatcatatttaagtagtgagtatacttcagtatttccagtgctgatgaacttcatcctcacctacctttcatgccaccttctgattcttcacagaatgtgctagcagacctttcacataccaaaatgcagctggaaacgacggcctttgacgtacagtccttcatctctgattatgcacaagatctgtctcccagccaaagcagacaactgctgagactcttaaatacaacccagaagggttttcttgacctgcaggagctggtaaccactgaggcggaccggttagaggctctcctgcagctggagcaggagctgggtcatcagaaggtttgcctctcttgcggagttgtgctcgctgttttacttatcagtgtgaaatcgtaacttaggtaaccaggaatactgaccagttagggcggtgcactggacaggcctgagcgggtgctgagcagaatccctgccatgtattgtggcagagtctgtcaccttgatgctgtcgggtagttgaggtttttcactgtcctcttaacagtattttgtgaggtgaacgtcttcatccttgccctgaaaatgagaaccagaaagccttcaggggtgtccaagagcaactgatgaaggtttagctctgaaccttcagggaactattccctctagtgaggcacagggctcagcttgtgctccagagaatgcactgtagagctgacttgcctaaatttacaccctgaatgctctactttatctgcttcctgtgacttagagaagtttcgtgccttcactttgtttgttaataaattgggaatggtaatgtttatctggtaatattatgagcgctgataaaataattcatatgatacccttagccctgtgcctggcctctgctgagcttttagtaagcatgagctgtgtgct

SEQ ID NO: 17507 - DNA, 1176 bp, Mus musculus
tgtgtgtatcaggtagtggtagccggggttagcaccagggacaaaaatacgggactctgggtacataattactcaatacaaagataggaagaactggctttccttagtctttccgtaactagaagctggttgagagattccggatgtgagaaatgcatgggaagttcagtcaactacagctaaaatgtcaaagtgcacgcttgaaggcagcgtagacctagagtaactgcttgtggctgtaagatttaattcttaattcccatatgttttactatgtgttaattattataaatttaggaatatgtatatttctaaatatataattaagtataattatatatgatatatactatataattttatttatttagatagacagacagatgataggtaggtagatagatagatagatagatagtgtgtgctataccgaggctgcatctataatacttatgaaccttccctacccaggttgcagctgtgaggcagctggaagagagcaaaaccaagatagaaaatcttttgaactggctgtcaaatgttgaggaagactccgaaggggtgtggacgaagcacacacaacccatggagcagaacggaacctatttgcatgaaggtgatagcaagttaggagctggcgaagaggatgaagtcaatggtaacctgctggagacagatgctgaagggcacagtgaggccacgaaggggaatctgaaccagcagtatgagaaagtcaaggtgagctatttaaacggtgaagccggtgaagccatcagattccgtgtggaggcatgggaaagagttcgactgctttattatacaagactatacaaagactttccctatcccagcgttacgccaaatataaactaccaactatgttcttagcaaataaaaacagtaagaagtaagtcattaggttcagcttttgtgcagagctgaagccctgttttagaaacaaaagagggctggagagccagctcagtggtttaagcaagcttgctgctttcgaagaggacccaagtgcactctcaagtgcatcacgatgtggctcacagctgcctgtaactcaggctggcctccaaggtcacccagaatagacatatatgcatacatttttaaaaaagaaagaaatgaagggggctgatcattgagctctccagagcaggggtcatg

SEQ ID NO: 17508 - DNA, 1163 bp, Mus musculus
gtgaacttgtaagtaagtcctgaccatagcttttagttaccatcccgtttccctggtacatttgcatcttcttacttctgtgcattggaggtctctctctgattatgacagaagctgaccatgaccgtcatgtgacggaattgtctctgagactgtcactccccacccctggcagttatcaataagtgttgacagatcaggctgagacacggtagtgactgcagtgacccaccatttagacctttctttcatctctctggggcactccaaatgtgtgtgcatctaaaaatctttaccgatgcagatcacaggcctgcgaatttttttttaactattttattatccacccaattcctgtctttatatataaacgttatgcctgacctaattattcattggaaatatgtcatctaggctttttttctgtggagactgaatttgttcattgtaaagtgcatttgaaaaaagaactgggcaagtagaactctgtgcttcctgtccccctctctgtgtggagcagatgacattgtcgggagatacgatgatctgtccaagtgtgtgaacgaacggaatgaaaagctccagatcactctgacccgctccctgagtgtgcaggacgctttggatgagatgctggactggatgggaagtgtggaaagctccctggtcaagccaggtcaagtgccactaaactccacagcgctccaggatctcatcagtaaagacaccgtgagtgacctttgctaaaggggggacagttctgcttgcacttgagagcaagttgttcatcttcaggaataggtagtcttagagacagagggcagcttctgaatgcacttgagagcaagttgttcatcttcaggaataggtagtcttagagacttagggcagcttctgaatgcacttgagagcaagttgttcatcttcaggaataggtggtcttagagacttagggcagcttctgaatgcacttgagagcaagttgttcatcttcaggaataggtggtcttagagacttagggcagcttctgaatgcacttgagagcaagttgttcatcttcaggaataggtggtcttagagacagagggcagcttctgaatgcagcagaggagccagcagtgcttggacaaatgaatatgtaaattttttgacagtgcctgga

SEQ ID NO: 17509 - DNA, 1159 bp, Mus musculus
tgtttatcactgcttcggccagctgctcatggggttcatcagatcaatcttgctgttgccaagccttttaaaaattaagaacatggctaatccccaggctgccttagatcccaagggattgccgggtggcgataagcccctgcccttttcaacctgccagctatccagctgttctccaaactcccatgaagagctttgggattggcttcctcaagagaaaaaccacacatgtcactcatttccaactgttaaccatttcagtcatgggttgtccaagcttgcggtgctgtgaagaatcaaaactcggcggctttatttgtagtcgtcattaggaaacatatgccgcaattgctgtatttcagatgctggagcaggatattacgggtcgtcaaagcagcataaatgccatgaacgaaaaggtgaagacatttatagagacgacagacccgtccacagcctcctccctgcaagcgaaaatgaaggatctgtctgctcgcttttccgaagcaagtcagaaacacaaggaaaagctagccaagatggtggagctaaaggccaaagtagagcagtttgagaagctctcagacaagctccagacgtttctagagacacagagccaggcgctcaccgaggtggccatgccaggaaaggatgttccggagctgtctcagcatatgcaggtgtgtattcctcagtggttacaatgccaagtgcgtgtggactggttaagacaagctcatgcgttttatcaacagtcttagctactgttatttgtctctctgtgaatcatttccctgctgagtagaaacaaaccatttaccacatgtatcatagctgttacaaccatccttgaacatgctaaatccacagagataatgaaagcacagagtgttaagtccctgcatcctgctgtacattcgcagtctgtgaagtgccaggtagtagatgcctgagctcttctccttgcatgcagaacatgctggtgggtttgtggttctaagatctggcaatgtttatactgactgatgtcattgctttgcaggaatcaactgctaaattcttagaacacaggaaagatctcgaagctttgcacagcctcctgaaagagatatccagccatggcttaccaggggacaaagctctggtgtttgagaaaact

SEQ ID NO: 17510 - DNA, 1114 bp, Mus musculus
agtaaccctgtctggcgagtgattaatggagtttgatgttttagagggcagtagttttgttgagatcttaaactcgagttgaaatggtcaccatgtccatgaatatgttgatatacctgtccatctgagataaatgaacctttggtgtttcactttgggacttggttttatttccttcctgttcatttgctgtttggtacccaagaaatctgttatgtttaagcttacaattccatcatgctacctcttacgttttacagttacacaatgctcctgagttgtttgttattaacttgcagtatgacctcttctttctatcctaaaaagtctgtggttcatcgtagcaggcttaacagtgtcaaaatagaagaaaacgctgtgtacaatcagtctaatgctatcgctcctctccaaaagcctcagcatgcattcgtgtacttttcttcctgctcgtaggtttaacatctattaagaaggacatgactgacataagccacagttacgaagacctgggcctcttactcaaggataaaatagttgaactgaacactaagctctccaaattgcaaaaggctcaggaagagtccagtgcaatgatgcagtggttagagaagatgaacaagacggccagcaggtggcgccagacacctacacctgcagacactgagtctgtgaagttgcaggtggagcagaacaaggtaggctgggtacagggcaggaaggcgcactgagtggacttagccagagcagccctgggggccatgagctcggttctgttttctccctagaccttcatcaaataatgactgttttgttaaaatcagtcacattggggcaacaaattgtcacttttccagccctctgacattataaaaaggaataaactgtagggtatgagtaactttgccgtctttaaatcagcttaaatctgcgatattaagtaatcaacttttgggaaagatttagttatggactaaatgtatcaagtgtctggcctgtctactataaaacgggacggctaataccgtcctctttaacagcatttctgtactgccaagattaggaaagtagtttctcaccaccatgacaaaaatttgggcaaattaccaacccg

SEQ ID NO: 17511 - DNA, 1232 bp, Mus musculus
aatgtctgtttgctggggctggagagttggcccagtggttaagagcactggctgctcttccagaggacctggttcaattcccaacaatcacatggtgactcaaaaccatctgtaatgagatctgatgacttcttccggtgtgtctgaagagagcaacagtgtgctcatttacagtgaatgaatgaatgaatttatgttttctgtaattcattattcaaccctttgtttattttccacggttaacctagattctgctgcaagagttcgacacccggaaacctcagtatgaacagctcacagcggctggccagggcattctgagcaggcctggggaagacccttctttacatgggattgtgaacgagcaactggaagctgtgacccagaagtgggacaacctaacaggacaactgagggacagatgcgactggattgaccaggctatcgtcaaaagcacacagtaccagagcctgctgagaagtctctcgggtaccctgactgagctggatgacaagctcagcagcggcctcacctcaggcgcactgccagatgccgtgaaccaacaactggaggcagcccagaggctgaagcaggaaatcgagcagcaggcaccgaagatcaaggaggcccaggaggtctgtgaggacctgtcggcactggtcaaagaggagtacttgaaagcagaactgagcagacaactagaaggcatcttaaagtcgtttaaggatattgagcaaaagacaggttggcctctctttttacatacctatttcctggtcagaagtcagcgccccgtcctgctgtttccgagctcttggtgataatttgtgactgcacagagcacagaaagcagttctgtggcagtctagacggtctacacagatgagacagagatgctctgcacatggtccatacagggcaaatgctttaactctgttcccagctgtttttttttcttttcaaatgcgaaaacacctttgctgtgttacattgtctttttttcgtcagaaaaacagacacatagttattttaaaggctttctgtcctttcctcctactattgctttgtatgatgtgtcacagaaaggttttgtagagaaacgtgtagatatctgtgtccctctctcacatgtagtgataattctgtgacaaacgggccggcactttttaaatgcaaagggatggatgaagggaattgtggaggaaggacagggctcgctggtctgttctgtt

SEQ ID NO: 17512 - DNA, 1990 bp, Mus musculus
ccacctcttgggagctaggatcaaaggcatgccccaccaccttccagctgcttattttaatttttactgttttactatttttattttagagagagaaagagaagaactcgagttatatgggtagaaatgtgaagaggatctggcaggagttgggggaggggaaaatataattccagtgtatttatgattaaaagaagaagtgagtgggtgattgatagtccagagctgtactagtattgactggtcattctgatgtagagaagacagtctgagaacaggcctggtatgttgtgtccacaccttgtaccttcatctttacctgtttccatggccctcatagctgtcttcttgccccagctccctttaatggtatttatgtctcctttttccctctgtcaatagctcaagtttgcttacagttcttttagtcagtgctaaaggtctgctttaggataatgtataccaccttctggaggtttttgttgttgttgttgttttaatagataatgttaaaaatcttaatacacttttggtctcactttcagagaatcatgttcagcacctccagtcagcctgtgcgagctcacaccagtttcagcaaatgtctaaggatttccaagcatggcttgacgccaagaaagaagagcagagggactctcccccgatttccgcaaagctggatgtcttggagtcgttacttaactcgcagaaagactttggcaaaactttcactgagcagtctaacatttacgagaaaaccatttcagaaggcgaaaacctgttattgaagacacagggggcagagaaggcagctctacagttgcagctgaacaccatgaaaacagactgggaccgatttagaaaacaggtgaaagaaagggaagagaaattgaaagactcgttggaaaaagccctcaagtacagagagcaagtggagactctgcggccgtggatagacagatgtcagcacagcctggacggcgtgacgttctccctggatcccactgaatcagagagttccatcgccgagttaaagtccctgcagaaggaaatggaccaccactttggtatgctggaactactgaacaacacagccaatagcctgctcagcgtctgcgaggtagataaagaagcggtcacggaggagaatcagtcattgatggaaaaggtaaacagggtcactgagcagctccaaagtaagacagtctccctggagaacatggcccagaagtttaaagaatttcaggaagtctccagagacacccaaaggcagcttcaggatacaaaagaacagctagaggtccatcactccctaggaccccaggcgtacagtaacaagcacctgtccgtgctgcaggctcaacagaagtcactgcagaccctgaaacagcaggtagacgaggcaaaaaggcttgctcaggacctcgtggtagaagccgcagactcaaagggaacctctgatgtgttgttgcaagcggagacgttagctgaagagcacagcgaactgagccaacaggtggacgagaagtgttctttcttagaaaccaagctccagggtctcggccacttccagaataccatccgagagatgttctctcagtttacagagtgtgatgatgagctggacggcatggccccggtggggagagatgcagaaaccctgagaaagcaaaaggcgtgcatgcagacctttttgaagaaactggaagccctcatggcgagcaacgacagcgccaacagaacctgcaagatgatgctggccaccgaggagacctctcctgacctcatcggagtcaagagggacttagaagccttgagcaagcagtgcaacaagctgctggaccgggcgaaaaccagggaggagcaggtggatggagccaccgagaagctggaagagttccaccgtaagctggaggagttctccactctgctccagaaggctgaagaacacgaagagtcccagggccccgtaggtacagaaaccgagaca

SEQ ID NO: 17513 - DNA, 1182 bp, Mus musculus
tacagtgaccttatcagtaggggttgtctgttgtcaaagccacatctcagtgtctgacacagcagttactcagccaaacgctctttctgtttattctttggaggcttttttaaaaaatgacatttatttatttatttatttatttatttatttatttatttatgtgccctgcgtgcgccttgtcgtgcatgtggaggtcaaaggacaagttgcaggagctatttctccccttccacgttgcaggtcatgagggttggtggcaagccaccttgacctaaggcactctctcactgcccccaaatgaattatttttaaaaccccactcctcatttttcccatgtctatccatgcgtatgtatgtatgtatgtatgtatgcatgcatgcatgagttctatcttatatttatttaaacattcttctgccttttaaaaacacggcatgttttgtctgaagcttctgcaaagacttctggaagaccggaagtctacggtggaggtgatcaaaagagaaggagagaaaatcgctgcttcggcagagcctgcggacagagtgaagctcacgaggcagctgagcctcttggacagtagatgggaagcgctcctgagcagagctgaagcaaggtacctagcggtgacatgctcagggctgtaggctgggataacgcttgcctttacgtccatgtcctccgtgtctgttcgtcacggggctgtggtgcaccagtccccgttcttctgatgtcctgtggccaccagccgcatccctgctcattaagaaagcattttccttcactggtaattcattcatttgtgcgagacacagtcattcgctacttaccctgcgtcaggtacagagctaggtgttagcttacgaggatgagctacaccggtgacctctgtccccagacaggtgcagactaacagactcaaagccgatgggaaatgaggacaagagtgatgctttgaagtaaagatgcagggtatgatgggaacacataacaggaagaagtttggagacagggaagcaatggccatgttttaagggaggagttggttagaaaggagtgaagcagctggcggtcctctccctctgggaaggagggagggctagactgtggcttttccaggctcttgctctcagttctgttattacagagtcacagccagtgtagcacctcctgtctg

SEQ ID NO: 17514 - DNA, 2206 bp, Mus musculus
ctgcaaaggaagtagaggtagataaagagccccggaagtgtgagtaatgatgagtcagcacaggaaggttaaatatcctcctgacgtaacctccttgtgagccatgacatcagcggcccgggtgctggcaggtttagccctcatcgttcttcaaagacagaaagctttgtacgggagataaaacgtctgcgcacaactgaagtttctgtaggcctttctattggagtttctcttttcagcaatcctggggaagaagtgaggatatcttttgggtcagattatctttagaaaagtgtcccctcatccccccaaagcataccatcagtagtgtctgaagagacctctgcccctcactttctcctcttccacaagaaataatacatcttcttggaattttaggtgatgaagtcttaatcattcaagataagttggaagccattaaagccaggtacaaagacatcaccaagttgagtgccgatgtagcgaagaccctagaacatgctctgcagctcgccggccagctgcagtccatgcacaaggagctgtgtaactggctggacaaggtggaggtggagctgctgtcctacgagactcagggcctgaaaggagaagctgccagtcaagtgcaagagagacagaaagtaggcacttgtgcatctcccacacgtgtgtcacctacaggggttgtatctgtgaggattccaagtacagtggccggtgggggggcggggcctgctggaaaccagctgtaaggtgacccttcagacacatgtgtcacctaagggggtgatctgtgaggattccaaatgcagtggccatggggggcggggtctggtggaagccagcagtaaggtgaccattcacacagggcatactgttccctttaagacaggtgactagaatgtagtttcctgcccaaggtagaataacaaagaagggaaaggggaaaaggaagatgaccactgtatcagaggcaggtaatttggctggaaaaacatttctgtcagagataggtagtgtggggactttcctggcaatacctaaaaagcacactgcctctcagagcattcatcccaacgtgtcggccgctgatcccatgagttggggaggctgtagtctctcacaacaccagcatgtcctcaccgcaggccgtgttcctgttggcgtgtgacaggccttgttgcttgacttctgttagccgatgacttaacatgttagctggtttgagtttgtttctccaaagagcaaatatttattttctatttcaaagagaaactcctgccatgttgacaaatgaactgtctcctaaacttctctggaaacacttttgatttttttttttcaaaacatcttttaataatggacattcgtttagctcagatgtaactaaccaggccaagcacagccttgtcaaccagcaaagaacccccaccccctccccctctcccaccctgagaacagagcagagggagaccctgccccggcgtttacccatgcgtttatatgttctcaaggaactgaaaaacgaagtcaggagcaacaaagccttagtggattctctcaatgaagtgagcagtgccttgttggaactggtgccctggagggccagggaagggctcgagaagacgattgccgaggacaatgaacgctaccgactggtgagcgacacaatcacgcagaaagtggaggagatcgacgctgccattctgaggtctcagcaggtaggaccggcgccttgttgccgaggtgcactcaagctgcccagggtctttacctgaacaaacgtgtcttgctgctggattcccactccagttgctgtgcttctgaaacgaacgtgggggtttcagtagactttcgccgggctatgtctgagcaccagggctctactaatctacacacggttagcaggcacctgcacccattacgtcacaggcagcacctgccacacagggaaagcctcgttttccaaacagaatgctctgtgtctacgtacatgcgtgccgctcacactagtcttatgcctagactgatgtatctgtgagcagtctgaattcgtatacaggttggtatctactgtcccatggtcatacttctgtatgcaaagagaaagtctctgtttttaaaaaggagttttcttggttgatgtagagttttttccaaagatgactaaagggggaaaaaattatagtttctgacctgcctgtgg

SEQ ID NO: 17515 - DNA, 1272 bp, Mus musculus
attctatgagttgttgttttgttttgttttcctcaattgaggaaatatataactcaaggaatccctttggacctaatctaaccacttaatcaaaactatgagttttacatgcactcatactttttaggatctcaaagtggttgtctgaaatgaataatcagtttgggcagccaaatgtgcagcttatcaaaagaaaaaaataagtttaattgtgataaaattaaatataggttaggattcatattgctacaaaggagcagagactgcttcttagtgaaaacattgagctattgatgggaaactcacgtgttctccccccaagggtgtctgtcacacggagtgcacagaggtcatggcttgaggcatggtttcatgcacagccgaatgtaaccttttggatggaaatgttgggagaggatcttcagcttttagtcagggggaagttttacatgcgaggtgacaacagcccatcgtttctactcgcagtttcatgacaagatcgaccagatccttgagagcctggaacgcattgcggagcgtctgcggcagccgccatccatctccgccgaggtggagaagatcaaggagcagattggtgaaaataagagcgtgtccgtggacatggagaagctgcagccgctatacgagactctgaggcagaggggagaggagatgatcgccagatccgagggcactgaaaaagacgtatctgccagaggtgacgagatgggctcagcctgcttgtttgtttgcttgttcagtttggtcttttgttttgtttttgagacggggccccaccctctctcatgtgtgtgtgtgtgtgtgtgtgtgtattacacacacatagagagagacatatagacatatagatatagtgttatataatatatatgtatatgtaatctccctggctagcctggagctagccatgtagaccaggctagcctcaaacttagaaaccaatctgcccctccctcccaagtgctgggattgcatgcacatcactacacctggcctcaggcttacttttaaaacatctctagattcgtatgctgttcactgacaggctggctgcataagaggaacaccaggtctttgacatgttaacactgggatgtgttgcttcccaaaagtcctgtggtgccttcctcggtttgcaaaatctactggttggaaacaaaatatggtcatgtaaagactgtgttctctgagcctcttaggctaataaggacaaagctggggatacagtcttggtatcttatctagtatgcc

SEQ ID NO: 17516 - DNA, 2243 bp, Mus musculus
agtggcaataagaccattccaggaacaaatcagaactacaaatccttctgtgactgaacaagcaatttcattgttggaggacataagaaaacacatcttgggttagttactttggggttaaggccagcctttgtgaacttaaagcttggtaaatttgagtctactctgagctcatgtagctttacgcatctactcttatgagaaggtgtctcggcacagctggagtggacccagagatcctgcgttgtgtggtggtccagtctgtatttaacaggttgagtaactgcttgctgtatgagctgaagttctgcttttgcttacgtgagggtaaccggtgtcttcactgacgctgttttgctgtgtagctgtacaggataagttggaccaaatggttttcatctggggaagcatccacacgctggtcgaagaacgggaagccaaactgctggatgtgatggagctagcggagaaattctggtgcgatcacatgtcgctggtcgttaccatcaaagacactcaagatttcatccgggacctggaggatcccggaatcgacccctcggtcgtaaagcagcagcaggaagctgcagaggtaagtaacagacctgggtgaactacggaagagaagagcaaagttcagcgagacaacccccccagtcctgttaaaatccgcatctagttctgaacgcagaatgcttagtgagtaccaaggtaccgtggactcacaggtgctgcttccagattgtccctaagatcatcgctctgcgcccaccctgctcgtgtctgtgtcagatagaagacagacagaccccgtccactgggtaaagcctgactttgcagggcaggatatgcagcttcgtgcacacgagccggtggccatgctgccgcaggcgttcctctgtcccttttccctccgcgctcttccatagccttgctcctcgaagcagtgatcatccctgccgcccctgtgataagcctcaaggtttgactggattattacccatgctctatactttctttctcgtgtacttggctgacgtgctttcaaggccgtagggcctggaagaagactaggtgaatgtctcctcctcagatgtttggtctggggctttgcccgtgcctgttaaatactcactgcctagtgagtgtgttcaacagtgaccatgaaaagcaaggtaggattgacagatcctacctagggtaatacatcaaagcgagcttatcatgggtttcccaacagatacgttgctttgcataaaatctttgtgctcttattttactggggtctctttggaacacataacaagcaaagtatttgagaaaagcaaaatgtcctttggtgcttgacagtatttgggttattttttaaattgctctggtattttgccacaaagttattttcgtctttgcactaaagagttggcgttagagaatattattttctataaaatatttttgttgttggtggtggtgtttttgtgttccaagaacggcaatgtgaggagcttgggaagtaaaaagaaaacaaaaccctgataactgacctcacgtgggaacccccacgggcggccctgcgcagccccgtgtcttggctttggtgttctgagcctctgctttggattccaggcaatcagagaggagattgacggcctgcaggaggagctggacatggtcatcacgctaggctcagagctcatcgctgcatgtggggagcctgacaaacccattgtcaagaagagcattgacgaggtacccgaggctcgtttgtgacttagctgagcgacacccatttttaccagaagtcaaaagtacaaacttgacactgaaaggactttaacatttgtttcgtagctaaattcagcatgggattctctaaataaagcttggaaggaccgggtggacagactggaagaggccatgcaagctgccgttcagtaccaggacggattgcaggtgaggtggccgccgtgtcctctggtctcagccggaaacaagaatcactctcattgatgtccggatggctgacactctggtcccagcccaaaaactgtgactatgtacacagctacagacaaatctattcccatagtcacaactactctgactcagcctttctagaagatatttcttaccctccagtcacacggatttatacatacgtttaaccatggattagcccacgtagccaatacatctactttgaaaagaagtggtctaatgttttttttaagcgaaagtaaata

SEQ ID NO: 17517 - DNA, 1143 bp, Mus musculus
gcccaccagtccacggtagaagccgtcaacaaagcaggaaatgatctcatcgagtcgagtgaaggcgaagaagcaagcaacctccagtacaagctcagaattctcaatcagcgctggcaggatattttggaaaagacagatcaaagaaagcagcagctggacagcgccttgcgccaggtgactagagaggcggagagagtccccaagtgatgcgggtgtgccttgctagcccttgtgcaggtccaatggtgatgctttaaagagaggagtaaaaataatcgggataaagagcagagctgataaggaggcggagctccagttcttagcctaatagcctaatacccttatgcccgagcttcctcggcgtgctcaggtagtgagcacagctcctggcacctggcattctgatgagatgcagagacggcttagcaggctggggccattttgaccttgctggagagtgatagcatttgtgacacaaacttaaaaaccacctgtcactgcaggccaaagggttccacggtgaaatcgaagatttgcaacagtggctgacggacacagagcgtcatctcttggcatctaaacctctgggaggtctcccagagacagccaaggagcagcttaacgcacatatggtacgtatggtattttctacacccctcgccctggtcttacatagataataatggaagatgatatagttaaaaaattaagttttgtggcaaaaatcactatgtgtacatgctagaaacagcaccatttagcaattaaatttttcaagtaagaatctgtctcagaggctaaaaaaagttttaaagaagtttagcagttctgtgtctgtctgtctgtctctctcacatacacacactctctttctctctctctctctctctctctctctctctctcacacacacacacacacacacaccaagcattgtatcagttataaactggtatcccctgaagtataaagacacttctctaaaatactctgatagtttaatatgattataattaagacagtactcatgagcgagtaattcatgtagtcctgtggtttgggtttaccgttcacagctaggccaggcccatttgcttgaagagcaaagtaagtagtcttgccaacgactgcgtgacctca

SEQ ID NO: 17518 - DNA, 1266 bp, Mus musculus
tggccccagcgggaacattgtcggctagctgaaacacagcaagcaaactgtgagtaccacacactgagtcctcttcctttacagacaaagttggaggaggccctgcacttggccatgaacttccacaactccctccaggacttcatcaactggcttacccaggctgagcaaactctgaacgtggcttctcggccaagtcttatcttggacaccatcttgtttcaaattgatgagcacaaggtacgtcagaacgctttggaaagcctgtgccttcatgttggaagcatcggtttagtaatatggaaactttctttacagtgtatttgcttttattccttatgcagtgtcttcattcccagctgcaccccaccccaattcctcctggatttacccctcaccttacccacccgagacctttcctgtgtcctttaacatgagcgttgccgatggatatgtgtacatttttaaagtcagtccacccctacacacacacacacacacacacacacacacacacacgtttctaattgcattctcttctgttggagaaaggtctttgcgaacgaagtgaattctcaccgcgagcagataatagagttggacaagactggaacccacctgaagtatttcagtcagaaacaagatgtcgtgctcatcaagaacctgctcatcagcgtgcagagtcggtgggaaaaggtggtgcagcgcctggtagagagagggcgatccctggacgaagccaggaagagggccaagcaggtaacaaactcggctgcggttccccagccctggcagccagtgagctggagctgtggagttatgcgatcacaaggttctcactgccggatcggcacgataaggagccatggtgttctcttcctgaaaggcctgtggcctgcctttgcacttctctgtcttggcagccaagtgagggcacggggactcatcttaaaaagctataaatagcccaacttcagagatgaccagggaggcccattaagaccttacttgttttgctgtatatttatttaattgttttttccccttgccgtttcaactcctgttctcctgctcagacggggtcacgtgttggagttatattgctagctctggaagccagacttctttcatgtcagagccgaaggccaggcttgcatcctcccgagtgcttcctgagggacctaactcttcatccatgtccctctcttccccggctgcttgttcgcagccttcatttcttccccaagattccgctcttggtgtgat

SEQ ID NO: 17519 - DNA, 1174 bp, Mus musculus
cagctcttagattctttctgccctctctcacacaatttttgaggacttgaagagggtcacaggcagcctgagtgccacagcacctgtctgccaggcaacgagtgcccactggaacagcagtggcgtgtgaccctaacaggagtaaccagatgagttgagatttgatctgaggtctgttatgggggatccaggcaaagatccagggctggggcgggtcatagacacaaaaagatgagcatgctacttttgtttcattaaaggggcatatccttgatatttatgcttataccaaaggctgatggttccctcagccttgggccaagaagcttctgtttgcagtgagtgacagttaatcgtagctggtcctgatgctgagaacaaatgactgagtacccagcctcgcacaagatcccgctttggatgctgttcaccatttagcaaacaaatagtcccaagcagaaactcagctctttccttgttaaacacgtaggagtttcagaaatcactcggaggcaaacattctgtctacgataccaccaaccgaactggacgttctctgaaggagaaaacctccctggcagatgacaacctgaagctggacaacatgctgagtgaacttagggacaaatgggacaccatctgtggaaagtctgtggaaaggtaggatgtccgcgcattggtgtctctgcagacctgcctcaggtgttcagtagggcggtgtttgcagacatagctcgtgggcctcagaaacttgtttgttttgacgaagtctacttgcttgcttatagatggtctcatactgtagtttagtggcctcttaactcactgtgtagccaaggctagccctgatcctcctctctcagcatcttgagtgccaggattacggggcattggccaccatgcccaggtcccagctctgccatttggctcctttaatttccatgtaactagtagaacagttatgaaaatataaatgagagcctcatcatttctctttctcacccgcattaggaacatggtattgaatatgaaataaaatagactccctaacgtggcataaaggacagcactgatctgacctgcgtcagcattccttcaaacttccaatctccctcctttcccgctggatttttgtgaggccccaaggtttcacattgaaactatcaagtattta

SEQ ID NO: 17520 - DNA, 1180 bp, Mus musculus
agaaatgcgatttttttttttttaaataaaagcatgcatggtataccgttttatagtacgggattctgtggcatcatgctggtgatgaaaactttcatatttgggaaatttttaatcttgaagtatttcggattttcagcctgtatcaagatgcactagaattcagctctaggaagcttcaaacatccaagtagataaatcttttaaaataaaactagcaaatttatttagactcttgaaggaccgggtaaggggattttgctgtaactgataccaggcgtgtatttaaaggcataaaagagaaaagtgtgttctaaggagatgagggaactcaggaggccactcacgcttcctcgttggtactacctaccagccatcactggggaacattagagagctgactctcacacttcctcttcagtacctccagccaccatcgggaccgttagaaggctaattcatctcctttttttccccccagacaaaacaaattggaggaagctctgttattttctggacagttcacagatgccctgcaggccctcattgattggctgtatcgagttgagccccagctggcagaagaccagcctgtccacggggacattgacttggtgatgaacctgatcgataatcacaaggtatagccacccagaacgtccttttattctactgtgtagttgtgcatctgtgtattgagatgaaggcaggcgcttctcgtagccttctaacctggaagagtgagttagaccgcatcaccgtcttcccactgatatgtgatcgagcagattccagaaggcatcttttaaggcatgggagaaaaaccacttaatcgactgaatgttttccttttaattacctgatgtacatctattttagacttgaactgtaatttaattttgtccttgtgggctctccattcagttatgtgataacatttaaaagcattcatttagagacttgaaaggcggacaccctctggatgtacagatcccccaaggggtcacgagtagatcctcttcttgatctagagtaatgcgtgcgctaacagcctgtgctgagagatttatttagtccaagaaagtggatttccttttgatgtcctaatgtgtcttgtaaattgagggtgcatttgaggtttccagctggtagtgagtatgacatctgcatttttaaattc

SEQ ID NO: 17521 - DNA, 1101 bp, Mus musculus
ctatacaaagaactttggaaagtcctctggaactgttgactagtcctgtcacgggtgactatgtagatatcttccattctgtgtgtattgatagtacgtatgttgtctgtctgtagtcacctaccattgaaacacagtcagtctgaaacctgtcacctgttcgccacactctggctggattgttctggataaactccctttgtgggatgatttgtgtataagcttgagtaattctattgtagacagaacactcgttgtctgaatatctagtcttatacacagacacttagattgatgatgaagagccctcggctcaatgccacttgtaagagtggcctgaggaagccattctcttaaatggcacattactcttaaatctgcctaaattgagaagacaaggtcagaggtcccaaaaggtttccaatgagatgactctaaactgtgaagtcacgggttggttcttaaggtgcttcggggaatggcttattatagagaaaaggaccacatgactctcttagattcgttggtctttccggacccagtaacgtgcaccaggcttgttcagtcctggctctgtagcttgtctctcagaatggtaggtaatcagccacactgactgtgagggtctggtattctctactgcatgactcaaaagaaagggaatttaatgtactgtgtgtgtgtctgtgtgtgtgtctgtctgtcaggggtgtgtgtctgtctatctgtcaagggtatgtgtgtgtgtcaggggtgtgtgtaattgaaattgagaaggccgatcactattatttaaatctaatatacttatatatttatattgtaatcttatatatttcattttttaatcctaaattaaatattactgaatataaacaaaatctattcaaaacagtgttaagtccttaaagaggaaccatgagctagactcagtcaaaagtatagtcattcagatctgtggtcctcagatgtatgtatgtggtgtcttatatacatccatctctcatgacaacgcacttggctatttaggttctgtactgaaaagtaacctgtgatgaaggtcagtatggtttctccaggtcttccagaaagagctgggga

SEQ ID NO: 17522 - DNA, 1129 bp, Mus musculus
catgggttttgtcccacctttccactgtgtctggggaataatgcctcgctgaagaatgttccaggagtgggggggccttgtgtgcttgtgggagtgaatggaagaactcgatgggaattgagctcctgtttaagatctttagcactttagattctgccgcttctgaaagctgcctggagtaggcatgctttagagaaggtatacttgaacatgagaaagcccaagggataaacaggagtaaacctggatgctaggtacatggctaacattttcctgaggacagacatcctcgaaaggggactcggtgcttcctcaggctggatctgagagccactggccagatctagactagcagaaagcttcctaggtctagctcagaaggatcctagttgactttttaaatgggtgtggtttacattaatgaaactaagttgcaagaacctgagcgagctgtgtgtccgtgcaacaggtgctggcctgggcgaagcagcaccagcagaggttagcaggggcgctggctgggctcatcgccaagcaggagctgctggagactctgctggcatggctacagtgggcggaaaccacactgaccgagaaagataaggaagttatcccccaggagatcgaagaggtgaaaaccctcattgcagaacaccaggtaaagaaactcaatccatcccctcgggtgtctcctttctcttgttgctaggcttctccaacccgttcccagactagtgagcctcttggcccgcagctgcattacagctggtcttattttaacttgactctccctctgggcggtctgatctcattgctgtggccctggcctgcacttacttccttgtttcctatctgcttttcctctgtcttctcagatgaacaaccatgaatattccaaatgcagcctacttagaaagggggtgccttctcgtcctcagagtgactactcaccctgagcaccccacctgttttaaatgctgaaatgatggctttctatgtgccctgattcatagaatgtttactggagctggagatatggctcaaaggttaagaacacttaggaactaaattcagttcctcaaaaccacatgtaaattcagtttcgggaattgcagctccctcttctgac

SEQ ID NO: 17523 - DNA, 2011 bp, Mus musculus
acagcagtagtgtccgcatgataagccagaatttaactttggtatatcaatctaggtattgttctttaacgtctccttagaatgctgcctgcccttgcatgataatgaaaagccgcaagaccaaggtattttcatgctagcacagagcacaagaagcacaggttgatgtaaaagctggtattgcagatgagtgatacaggttcctcacctctgtcctctgtcctctctctccagagtccaggaagactcccagccgcccagggagcagagccggaagcaaagccggaagcagagccagcagccgccgaggcagcgacgcgtccgactttgacatttcagaaatccagtctgtgtgctcagacgtggagaccgtcccacagacacacagacctgtgccccgagcaggttctcggccatccacagccaagccttctaaaatccccacaccccagaggaggtcacctgccagcaaattagacaagtcttcgaagagatagtgcaattggctccaaccagcccttccccgagcatttactatttaagcgaatgatgtaaaatacgatgtagaaattactgtgaaatattgcaggaggcaagttttaaattctgcagatggccttatttgtgtatttgtctttttatttgatctgtatcacttttttggtcagattttctgggggtaaaagtcacatcatatgtgataaggaagaaagaacttaacatgaactgatgtttctgcactgtcgagtgtagaccatacactaaaagtcagttactgtacctacaggtaagtccacattctctctgacaaccacagcactacatagctgacattaagggatacctcatgacaccttttatggagattctgaacagctgacaaaccaagcagggaattgtatttttatttattttttatttttattttttgcgatgctctaactgtaaattagacagaagacaaaaggaaaaacacaacaagacgcagttcttcgagcagcctccaagagagaatcagagtcacaggaaaacgcctcaagcagccgccggtaccatggcgttcacacacctcccagtgtccttgtgcctctgcttcaggcgcagccagacgcgccctgggcatccgccgtctctaccatagggatgcggtgctccgtgcatccgtgtacacgtgcaaggttttgctctgcttgggtggacagcagcccctgtaccactgaactcattttgtaacagcaatttcgcttgcaaaaaaaaaaaaaaaaaaaaaaaaaaaaaaagctctgaaataaaacacatcccttaactacatcgctatggaattaattttttttccccagggaaaactggtgtatttttttatgaacagtatcaatttggagtgaccaaaagatacttgaaaaaaaaagtgggcttattttgatttctcatctggaataatcatgttctggtattatatctacttatatttaataaatatgcattttaatttattatgtatactcacatactagagaaagatattagtatgcatttaataaaacatattcacttgaacgtatggaatacttggttatttgaaatgagcttttctgtttgttttaaataaagggtaaataatagaaatggtaataatagatgatagtctgacaggaaaggctgggaggtgtgtaaggaggtagagctaatgggaagcacccattctataagtatttgagaaatcctagctggtatcaatgacatttaggctactacagtgctcctgtcctcaaataatcaagggagatgtcttagggttttactgctgtgaagagacaccttgaccaaggcaactcttataaggacaacatttaattggagctggcttacaggttcagaagttcagtccatcatcatcaaggcgggaacagggcagcatccaggcgggcatggtgcaggaggagctgagagttctacagcttcatctgaaggctgctagaagtctggcttccaggcaactaggatgaggatc

SEQ ID NO: 17524 - DNA, 1268 bp, Mus musculus
cgcaagggccccaccaagaccaaagagttaggatctgctgtagttcctcaagatcccttgaactggtttggaattttggttcctcacagtctgcggcaggcccaagccagcttccgggatggtgagttttaggactattgtactggctagggaggcctaacacccctgcagtcttaggggttgggggggcggcactccatggatcttaccatgatgacattcctcttctctcaccaggcctacagctggctgcagatatagccagtctccagactcgcatcaactggggtcagagtcagcttcgaggcctccagaaaaaactgaaggagttggaccctgggcctgcctgacctgcatccacattgggaggcactgagcatagctgccgtggatgctaccaccttacctcaggccttcttctttttataagcagcccctgtctcagctgatgccccacctagaaatgtccttagtctgcgcggtttctagcttttcgaggcatgaagttgagttatgaagtttgatgaagcaaagctgagcagtgtagagagcacctagttctaggccatggtctcagggcatgacagtgacgtgtgaataacctgcggcagccatctgggatagtgaagccctgcagaaatggtgacagagaagaaagggagtctagaaacataaggtagatcaggacaattccagtcaataaaagtacctcaggctgggcgtggcagcgcgtgcctgtagctccagcaactctagaggctgaggcaggaggatcacttaagccctgggaagtttatagacaagacagcacacacacacacacacaaatacacaaataccagaatagctagcaggaaatattacttctgttataaaaggaaaaataactcattcttccggggaatcagggtgaccttcctgattgcacttagcttatagaagtgagacccagctgctttgctgaaggtgcattctctcacctggaaactgtgtcttgcttcacgtttttttcctgagctatccagttgtgttgggaaggggaatgtaattgtttgtggggtgtaaatatttcttcctaatttgttaattttgcttatattggtttttctacttatgaattgtaaaaacagaaatttgtacagaaaaattgaataaagtaaaagctacagtaagtgtcacagagctctcattttattttcagtgtatgggggctttcccagtgtatgtctgtaccatgtggtgtcttctgcccttcggcgagaagaggc

SEQ ID NO: 17525 - DNA, 2011 bp, Mus musculus
catggtgtcatgaaaacctaacgatagtgagagaacagaagccatctggatgatgtgcaaggcccttgaggtccaataagatgaggaaggttaggccagtgctctgggacgggtgggcccacaactgcagctcatgaatccaattctcaacaaggcctctgggatcctcccatggctttgcgtgtggtgtgtgtgtgtgtataaatttcaaaatgcaagtaaaatcatgtgatctatgttttttgtttgttttgagacagggcttgtgtagccctggctatctagctgtcctggaactcactctgtagacctagctagttctgagctcagagatcggcctgtccctgcctcatgagtgctcagactaaaggcgtgcacctccacagcccagctctgtacatttcttatggctaccataagggattcttgtggagctgataatttaacagaaattggttcatggtgcgaggtgagggtgttcactccctaaggctgagtgtgttggggatgggggtgtgtttgctcttcggcttctgatggctgcagtaaccctttgtatcgcctcttgctaccatagcacttcactgtcggccttcatcttcagtgctgagtctgttgacctagtctcttgaatatttcttagaaggacctttgttactgtgcttactgcacatgtctaggtccatctcatttacaattctgaacttgtatcttcagagaccctttcaaatgcactcatatttacagattttaagaattaggatttttttcttgtaatctgtaagagttgcctgcatatatatctgccacctgatgaggccaggagaaggtgtagcatcccctgggtctggagttacagacagttgggagccatcatctggatcctggagattgaacctccatcttctgcgagagcacctcgtgttcttaacccaagcctgcctttgtaaatgagcttgctctctcttgcagctctacactctctgtcctgcctgtttagtgtcttaattatgatgtgatagaaaggtttcttttctggtcttgcccttttggagttctgagggcctcttggatctctttttgcacctcttcatctagagttgggaaatttaaaagtatctcctttctgaattcatttggcatgaaattcccctcgtatgcccataattttggcctttgcataatgccccaaaggtcttgcacgttttattcacacacacttacatgcatcattggccttgactgagtgatgcggttctgccttgctctgaagccccgcctcctctcctgtatgcaatcctctctattctggggcttcttcccactgagcttctacctgacctgcacttttcgctttctaccctcatctcagttcaggttttcctctctgtatgtctttatcaaattctactttcacatcttgaatggactttctgattccatgctgatgtttgtgttctcttggtgactatccatgtcctgtctgggttgatggattgctttggtttttttttttttttttaattgtgtgtctgaagtttatgtaagtcatcttcatcgggggccagtattgtggaattggtaatttttggagaagacagattgtcttggtgtttcctattattcctggtgttgtgttgagacctggtgttttaattattcctaaatctaggttgcctttctgcttttagtgggaatgctttcaatattcaggaaagaccagtaaggttgagttgacattttcttttagacttgttcagactctatccctgacctgcacaggaagtcggagagccactgtccatcaataaacccaccgtgaaagtagtgtcagttaactacgaaacaggcattccttaaatgccaactagtttgggggagtaaagggccacactgtaaagggccacactgtgctgtgctagtgtattggttactgagtggagagaaaaacaccacaacaggactggttattattgctaggtctcagttaaaacagaacccaaaagacgaa

SEQ ID NO: 17526 - DNA, 1203 bp, Mus musculus
attccactccctggctccaagcttcaacttttctcctcacaggagactcctgaagaaaacccagttccttggagattgccacttcagtagtctgatggaagggagggacacagagagcctgtttaaaacatctttctgccaggatgggtacaccctcagccatgactctttagctccttccaactgtgaccatgacctgagccccttgcaaacactgatctacttttggtctcttcaagcctgcctgtcacacttcatatgagtaaaatcatgggatagattatcttttgtgacttgctgctttggcctaccataatgtttctaaaccttgtagcttatgtcaagacttcatttcttattgcccaatagtctgctgtaggcatgagaccatatttatcagtcagttgatgaaaatgtttgcttttcagttatgcacatttgttctaagtatcatttaagtttctctttattttgtctttgtaatttatctatttaggaaatacgcttctctatagtttacagtctgtggtatagtttacacacactgctgtcgtttaacctgtgcgtgtatattgtatttcctttgaatttatatgtctggtggttctttttagacagggtctcatgtagttctgactgtcctggaatttgctgtggagaccagactggccttgaactacctcctgcctttacctcctaagtgctgagattaaaagcctgtgctaccatgcctgatctgattgttcactgctaaataaagtcccagaaaaaaagtgtgctgaggttgggttaatgtcagagggaagctacgggccagccatgctgaccgggttcatcattaagagcctctcgtgctgctagcaacatgtatgaacacttgttgacgtaaccttcctctaagggagtgtgaggcagatgcccaggtctgtctcagagaagattacagtctagggcagtggttctcaacctgtggctagtgaccccttgaatgaccctttttcaggggccatctaagatcattggaaagcacagatatttatattacaatcatagcagtagcaaaattacacctatgaagtagcaatgaaaataattctatagttgggggtcaccacagcatggggaactgtattaaagggttgcagtgttaggaaggttgagacccactgctcttagggaaaggccagcatgggtatttttttt

SEQ ID NO: 17527 - DNA, 1099 bp, Mus musculus
tcctctgtccagctgtgggaaggccaggatacctgacccgccacaagcatccatcattgcctgccagccggccccagcagcaagtgttggtgctagcagagcccaggcggaagccatctaacttctggcacagcatcagcagactggcgcctttccgcaagtgagccagcatccatcagacaacctgacagcactttgtggacccatcctttcctctctgaggcctataccatcaggccctctgcctgttttacaaactggaagtgaacaggcacagcgtcatgctgtatgaagtctgggccctgcctctggccccttccccatggctagtgtgtgagtaccagcctctgactatactctggacctgcgcagagcctccatcaatggtaagcctgcacgccacagctctaaacctctggccaggctgtgcacataggcgcatctgctctggacattctttggaaagctatcatctccattctcctgtttcctctgggtaggagaccaaaatctgtggccatgagccacctgccaaagcaggtgtgtgcccctctgctctttgtctgttcaggcccccagtgcacttgtaacctgagaggtcaggaaccaggaattatgcactaactctacccatacatagctgtccttatgcctcctggtccctgtagacactgctggctgccagataccctctttacttgtgacatgtgtaacgagaaaaccatacagtcaactgtgtccctggttccaggttagtgacagttccctgtagctggggtggctgcgcacacacccacccactcactccctgttcactatgattttggtcgtgttgtttctctaacactggagaattgttaatgacacagaaagattgccttaccctagttaagtgtgagaagccataaggactggactctggcccctcatggccggcctcctcgtgaggcacatggccgggcctgcacatggtgcagagcctacaggactcagaagcatggagtcactcttgcgctgcatcttctctaatccaaaagacacatttaatttcataaagaaacgaatgaaaagtgacctggctgctggtcagctggtggtg

SEQ ID NO: 17528 - DNA, 2879 bp, Mus musculus
tgagctttgtatcttttgtcagccccattgaattcctggggctttggttggaaggggtgcttgtctctggcagctaagtcagggcttccatgttggtgtagaggttgcctcagtagcagtcaacttggctagaggctgggtcacctgaatatggaaccttcggtgaccttatttttatagtaatgctctccatagtttttttttaagcattttattttttgagaagtttaggaaggttgctgcatggatcagtgtgaacagaagattcctcattccttatgtctatgaacatagaaagtttatggatgattatggttaattgcctcatgagcacttaggtgtgtgtgtgtgtgtatgtgtgcgtgcgtgcgtgcgtgtgtgtgtgtgtgcttggatgtgcgcgtgcatggggagaggggtagcaccagcaagcacaccctgcacagagatagacacgcttgctggagcacacagcctgcacccgtacttccatgttgggatcccgtccctgtgctgagtgacttgcagggttgggatttccaagttttctctggactcatcagacagaaggggatttctttagaacaaatgtacctgtgattttcacgtgtttgaaaaagtccccttatccatccccaactaaacatggctatctccctgcctggaaagggtagagttgtttgcctacagcaggaagttaccaagtctttgagcctacttgcagcaacacacagtgtgtgtgtatgcacaggccctgagttctcaagagagagggaggggctgctgccctcctgctgatcacatcagcctcacacacttgccctggaactgttgaaatggagtgactaccaaacacctctgtagtgtacaactcggctgggtggaaatcttgtctgttttgaagctatcaggtcatcactgtgggatctgctggtgagagagcttaccaggtgaaaatctgggtatatggatggtagtgaactgtcacagggggtgactttaacaacattcagtttcagtaaaaataaggaacagaattgggtcagtattctactacatggctgtacaggtatcccaaaacattgaggaacattccaagacagtgtgctttctatgagtgtgacattcctgactagagtccttcagctgaattgacaggcaggcagagagtctgatccctatggacactgacatcgttgttaaggagatatatagatatatctatatatatcaagtttattttctgctgccgtccctgaggctaggggccttccttcctcggctgctgctgcttgcagtttagagttgtggagtattggaaactgtaagctccttgactctggagaagcaaacccaccaccatcaggattgggtcagttaggctacaggcatggaagcggcctctgcaactgttgtctctgtgttgtggtcttccttggaggaactgttgagtggctgttggctaccagttgccatcctgagtagcagcttgtgagtgttttgcattggttgttgagtgtctactgttcctcggccatgcacctggcatggtttgttgtttgatgggacaggaggctggagaagcagactgggtgttttacagtccggtgagaggaaagtcagtctccgggagggggaggcttgagctccctgccttctcattggccctctgagtgtgtctgtggttgggagaggttggcaagcaccagctttacacattggggctgcctcagatttccttagttctccttctgaatattggagtttagtattactgtggggccaccttctctcagcagctggcatctgtacttgtggtatatctggcactgccaagtggtgcaggacctcccagggtgcagtggcaagtgtggcagctactggtcctttcctctggtgctttctgagggttgcagagggcaggtgtgcagtagagcttcctctcgtgtcctgctcacctcccagggttttacattttctgagttgcttactcctgccctgtcttctgtgtttggtggagtgatgatgtggtctcagtaggaacggtaacattgcttcgccgtgtcttaaaggagtcttctcttccctagccctccctgttcatgtgaagaacagaaagcctgcagagtaaatctgactagaatcatggcatgggaggcagcagcttttctgtccaaggactgcagtagctgctcatgagctgtgaggacctggtgggtatacaggcagttcccagggagggcagtgggtacgtctggtgcagaccgtgggcagtgtatagagcagttgggacagactgggggctggctcccagcagggttactgtggcagctggaggccccaaggagcctgctaggctgtgacggaacagaaaaggttcttcgtttttaaacttttgtttttaaatactcttttttacactgttgttggtactttttttatgcttaagtcagcattgtcttccagtgttaaaggcatcccttgcctcttcatggaacttatgtgtcaaaacaaaggaacgggcagactgtccatcccaagccagttcaattagatgtaaattcatactgttttaattttttatgcaatctgatgagtagatgggctcagatttaaaatccttaaaagcacgtttattgtaaccagaattgttatgtaattaatactgcagttttcaataaagattgacttgtgttgcatattctgaccttttcgtgggagtgttttcagagggacggtctcactagcacttgctaccacttcccctggtgaagaagtgcctagaggactgggacaaggctgtgtgttcagccttgatcagctttggtggagcatcctcctacgtactgcaggaggtgtaggcttctgcagctccacat

SEQ ID NO: 17529 - DNA, 1183 bp, Mus musculus
ccagctgacatttgtttttctgtcatctctgatagatgggatatgtgacaacatggtacggacgccgttcagtgtcgctttaataagcatgatgctgattttacatcctgtgctgtatgactgccatttgctcacagtgtcaccattgctaaagctccgtgctttacttacaaaacactaaaaccagtggttagtgtttcacagtgattttaattttagagttagttactggcattcctaaagccatagagtactgagtcacatccctgaagtacttttgaaacagaattgtctcctactgtcccatgggtgtgccctgcctgtctcctggccccaatggggctagctgtaccaggcagccatagttgagcctgatcattcctgtcaccagtttgacttgattatatacccagaatggaatacattcttgggcatctcagttcctcagccctgatcctcatagacgccaccctttcgatggcttttgcggcgtcacttgtacctcagtgagtcctgcgattcttgagttagagggaacgacttgtccagcattgaggaacatgtctcctccactgagacttaaatgatgatgcagggctggaagaggctggctgctgacactgcatcgtggctgatgtcattgctctcctagttctttgatttaagaacctttcatatggaaggcctgaggctccctcagatcgtcccttgccaagaaggcctggcttaggtcattagtgcccacagtagccttctggagtgtagcaagttcctgcgtttgagacagaatggttcagatttattttctacatctgttgttgaccccatgcaccctctcattttgccttccagtctacgtagatgaaagatgaaaggcagaggatgcagacagtcttctttgtgattgcttctgttattctgttgcatctaccgagcccgttttctccctgtctgtgcatacagtatgtttataagtgaacttgttaaaatattaaatgatcactaaccttaaaccgtgtctcattgtgacttctgtcgtatgtttaaattattttgaggtggctggagcagtagttaagttgcctgtcacaaaagcatgaggatccgacatcagacccttggcacccgaatggaagctagatgtggctacagacatctgtagtcgtagaacttggagcttgga

SEQ ID NO: 17530 - DNA, 1175 bp, Mus musculus
agctccaatcctcattcttgattgtcaagcacttcaatgtcagagctatctcccccttaggatacagaggagcaagcaaccacatacatctgtttgtaagcttatcaacaaattaacatagctgccttaaaggtatggaaagaattgccccaaaaagtaaggaaaaccttgtccctaactgagattggtcagggcctggaagaattgtacccagactttgtggctacctccttccagacctaggctattatattcttagatgatatatattgtgatatgtatagtataatataatctaatagattggaagtaatgtatataataatcaagaaatactcaagagaattttctgatctaccttttcaaatagtatttttttagttcattggtgttgacaaactaattataaagctaatagaaagagcaattaatttcctaacctttggtatctgtctctcctgacctgagaggggaaaagaagacatgtaatgaccccctccctttccctcctattggtttatagatcagaacagggatgtgaaggatatactccatgagacctaaacatgactcttcttaaaaaaaaaaaaaaaaaaaaaaaacagataaggtaacaggtaagtacttagtggggattcgacttggaggaaaagacgaaatgaataatccttcaatacttaaatatttattaattaaattgaatgaattataatatgtaatataataaataattaatgcatgattaaaactacaagcacaggaaatgtcttctacatgcacagactgatatgcatgctgaactggactacaagaaacaaccctaactcacagactcaagtgtctttaaggaaactagcagaccttgggccccttaatttctcccactatagaatgaaggacaggaacaaggctatttctttggctatgactttacaattagcagcttcccccaacattcattttgtatttctttgtatttcttccttctcttatgcatcttccagcacaacccctttagtgaactatgcaattggtttgccacccaatgtcaggcaacttttaaaacactaaatgagactttgactggattgcctatcagcccttcatcttgatttgcatcgggagtgttgtctcattgctaagaaaagacagtaaattatagagtactgatgatt

SEQ ID NO: 17531 - DNA, 1137 bp, Mus musculus
caaggcaaattagtccaggcatctccaggaagtcacagagctgcttctctgttgtcttgtctctctctttctaaagtttaaggcgtgacttctacctccctgactcccaagcaaagtgactttgaactcctgaatttcctgcttcttccttcaaagtgctagctagcatcacagatatgagtcactgtttccagcttatgtggtaccagggatgaaacccaaggttttatgcatactagcccagtcctgcactgtctgatgtgtttgtgtgcatgggcacacacattatgtacaaacataggtacactaggtatacaggtatgtgtgtatgtgtgtgctatgtgagaaagcctggggacaacctacgtgttgtttctcaggcagtactcacctgttttgagacagggcctcttattgccttagaacctgcctgcaagctgtcctagctggctagcatgtcccagagatctgcctgtctctgtcttctcagctctgggattgcgaacatctgccactatatttaacattttccacgtggattctgggaacagaactcgggcactcatgtttgcccagtaggtgatgcaccaactgggctatctcctcaggactcttttgttttttttgtcctaagaactgaacccagaatcttggacccagtaagtcagtgcaacaagcgccaggccagaagtcagtctggttaggatgcgctgcttgattctgaggtctggttaccatggagttatagattctctctgatttatgctctcgggtcacatagaagctaaatgctctctgtgtcattttatcctggccacaactgaaaactcaagtcttatgttttaactttgtttatggcaccacataagacattcagattgttgctcaaattaccagcctttcatcttctggcttttaaagacattttatatctgttaaagaatctctgcctatgcaatgtgtctatttaagaaatacgtgtctcataaagtctcctccagtgttataaatatatttacatatttttatttagtagctttatggtacacatgtgcataaaatacatgtaaagtaatttttgatatatatatatatatcctagttttattctcttaaatcttcagaagtgaaaatctt

SEQ ID NO: 17532 - DNA, 1120 bp, Mus musculus
ccggaaaaccactcagagttgagggactgactgtggtcccaagctggtcatcagaagatgtgctagtccggggtctttccagaggcctgcctgtgttaacatctgtttccaaggctgcctctgaggaatactatacttttatggtccatggtagatgcttagttttttacttaccccacatatgatgaagcacctactcttggaacagcagtgggctctgccatgatggcttcatggccctcttccatcatatgcaagaagagatcaagctgttagaagattggtaccctttggggtgaagggcatggccagcagtatccccaaagggtggtgctagttctccagagaaacagaacccataggatataggtagggaggctgagagtggacttatgggaattcgctcacgtgaccatggaagctttgttatttcagggcatattctctgcaagctggaaatccgggaaaaccatggctcagtccaagactgaggacctctgaacttggtagccgttgataacctgaagtgataatgcccaatggcagaaagagggtacctcccagatgctgaagagcacatacccaccccccgcccctgtgccatttccttatgtgtagaccccttagctgtccatgtggtccctatgtacattcagggagacggccttacttggtccactgattccaatgccaggtgcgcttttccagccctctgggagtccttagtaaaggcagatgacatctaaagttggtcatcatagtacactgacacagtacccaaggccaaatgtagtgtcaagtatcccatcaaaatggccgatatttccaagcacctacttgatgttcctaaagaacaagctggacacagactgtatgaggtggtctgtgagcctaggaggcaggatgtgttgtttgagtgatgtgttaatagtgcatactgtggagagcctgcatttggtcagcagacacctctgcggtgcctttcttgaaccagggagggacttagacccctagggagttaccatgcattcctgaggagccacagaggggcctggagaagacagtgttgtgggcgcaggccttctcagctgaaggctcagcaaggaagtaagcacagggc

SEQ ID NO: 17533 - DNA, 3538 bp, Mus musculus
ctgatgtccccaaacctgccatcagaatgtgcacaggagagacatcccattgccctgggtttgtgctgcacagaggaggagaaactgaagttcctccttcacctacatatctgcgctcttgctctgaccattctagatatagagttcagctgcctggtcgtcatgcccccccccccacccacacacacacacaccgcacccccctttgtaaagaattcccttgacaggttccatccctcagacccagggttttctcctcagaaacgagcaacgaatgtcagagctgaggagagcttacttgatgccatgtgcccaagggtccatggtaaagagctgtagtcaccacagtgggtgcagctctctcccctttccaacagtactgatctcttccccgttctcattgtagaaagttctactacatcaccctgctgcgagaccccgtatcccgctacctgagtgaatggcgacatgtacagcgtggggccacgtggaagacctccttgcacatgtgtgacgggcgcacaccgaccccagaggagctgccgccctgctacgagggcacagactggtcgggctgcacgttgcaggagttcatggattgcccctataacctggctaacaaccggcaggtgcgcatgctggccgacctcagcctggtgggctgctacaacctatctttcatccccgagagcaagcgggcccagttgctgctggagagcgccaagaagaacctgcgaggcatggccttcttcggcctcactgagttccagcgcaagacgcagtacctatttgagcggacgttcaacctcaagttcatccggccattcatgcaatacaacagcacgcgggcgggcggtgtggaggtggatgaggacactatccgccacatcgaggagctcaacgacctggacatgcagctgtatgactatgccaaggacctctttcagcagcgttaccagtacaagagacagctggagcgcagggaacagcgcctgcgcaatcgcgaagagcgcctcctgcaccgctccaaggaagcgctgccacgggaggacccagaagagccgggccgtgtgcccaccgaggactacatgagccatatcattgagaagtggtagtagtgtcaggggcagagagtgatgggcacgatttaacagggaaagaaatggggccaacagttcttcctgttcggtgcagcgggtgctagtaggatgccctagtccttgatggggcagggtaggacctctggggcagatggcctccctgctcttctggcccccatgtcatagttaaaactgacaaggatttgaaaaagactggcgagggaacgtgtctgcttagccgagactcccatacctactatgcacgcactggcccccaacgaccagccccctaggaacgtgttactagctcctaatagcttggttgaagctccttggcctctgaggacccctaataacccagaatcttggggagccctttcctttgagaatacaagcatgtctctgaggcatcctcagacctggagtgctccccaacccccacctatcaaagctgctttcaaggtcagggtcagccccagctgtggcagagaagactcaagtctggtgcctggcctctgcactgtctggagcatgatcagaatccacggtgtatcctggctttaggggaaccaggttcaagcaggaaagggatggacaccaagaggtcttccccccacccccagctccccaccaatccctatgctttctgatgcactgcccctcccccatcactgaaacatttatacaagggcttgtgtgccaatgttcctaccataccagcaactctttctatcccgtgaataaaagcatcccttggctgggatatagggccacatcaacctgagttggtactgggtggccaggatggggactttcccattctcagctgaggttggaagaaaccactctgggtgtcctttctgggacctgtctgcataaccctccccatcctggctctcctgcatcttcttaccctttacaaagtctgacccggccatttccagcagacctgtgagccagccagggaccggactagaagccatgttgcatattggggtttttgtttgtttgttttttaagcacttaccaagtgccctatccctggcaggcccctagtgggggtgtcgtggcttttttcagagtctataagcatgcagccatgggttgtgagctgaccttgagacaggacgggtcccacactccctgcctctgtctcactcaacactcaggctaagaaggagcgggtcaccacagacaagagtggggccatatgtagcacagcaatattccagatgctggtgggtattgctgctgccctagagcaatggcttaatcttcacacatgtgtggtgtggcaccaggcacttgaccttggggggtctacaagcaagatgagttctgataggcacagtccagcccagtctagcaccaccttttatggtagttgatcactctgaggaggtgggtagcaagatgaattaggaggtcaaggtcactgagaggaatttgtttagatgcccagtttagagtgaatagatatctgcggggaacctggggcattttggggaaccctggggtcttttacaggtcatgttggttgctgctgcttctgtcaggaagtaccctagctccacgtactccccgccccccgccgcccccttcacaaccttatgtgtacatgacctgaacataggatctgttctatacatactggaatatgttttaacatatgccccaccatcctgactcacacggaagcacgggtctcttctcaatctttgctgcatttggaaaatgttccctcccatctcaggccagcgccatgtcgaggcatcttcagtccacccctgcctaaggctcaggctacctgctttggggcacagcttcctggtactcacagcatctcagaacagggtgcttccctctgcctccagctccaaggactctgcctacaggagtgtgccttggggctgaaaggccatgcaaacacaacaaactaataactcagtcccaaagcaccctgcagccctgcagacaccccccccctccaagagtgggaggcagggaccacagaactgtccagccaacacgtctgaactggaactgttccacttgaacccgggagctttaaagctttatttatttatagcttcttattaaaaatttaaaaaaagcgttgaggaggaatcctttggttattcatacggaattgatgatggaaaagcaactggttgtcttctaattgtctttgtctagatggaaactgaaccttagcagatgaataaaccctgaaaaggtcattgtgtgctgtggtctgtggtgacttagccctcccaggcattgcattggcctgcatcatatttcggcaggggtgacagcaaggctgctccggtgcaggtgcccctccccctgcacaaagtgaggcgctgggtaaggaaaaactcatagaccacaaaaggtagaaacgtacatttattataagacgtgcacaggtgaca

SEQ ID NO: 17534 - DNA, 3998 bp, Mus musculus
gctgctgtgagcacgcatgcacaccatagcatgtgcacacagtcatggtaaagtgcaagtgcattgtgcaagaatgcctctactgaggctgcatcttagataactccaggaaaagcaatacacacggagagatgtactttactgttacgtaccgatcagcaaccttaaaacagtttaaggatcaaagaacagctgccctggctcacagaaagaatgtgtaagtgcagaagatttctgcacacagcagtgtgtggcccagagccagctctgccctgctggagaccccgagagccagcgctgccctggtggaggccgtgtatagcccaagggcgtgtcagttcttagagctaaaaatgtcttcttctcttaggttcgctttcaacccttaatacagaaatagccaacaccaagcttctacagaccatctgaagctacagtgctgtgctgggggcagtgtcacacgctgttttatgacgtaagtctcacggtctgtgttcttcccccaggctctcagaagcatgaggaattatgatctctggaggaagatgggaaacccaccttgacagtttggactaactgctgttttctctgatctttcgatacgactgctgatgaacggattgggcaggtgtaccacacctattgatctgagcattgatttagactactgcaccctagtgggtgctagatccttggggctaaggctctgttggatttgtacctcagaggaagacaagtggctggtcttctgggactcttcttctcaccagagggagaaatgccggcagcaactgcaagaagcccagtccttcggtgcccacagcccagagcacacactgctgtgctggcccagaagctgggcagaaaggtcaccatgttcttccttacctcagtttacctgcagcccttgctgcagtgcagatgcccaccctgtaccaggtcaggccggcagatgcttcatccatgcctcaaggtctacgccaacatgcttctcacgtctcttcccctccccaccccccttcccaagcactaggcttgttgtttaatggagcccaaccaataatcatgtgtcttcagggttggctcagtgcagttgctaagcaaatcagtcttcaggagaaacggggtggtgtggataaggctggaagaaatggcaggtagtggagagtgttggggtgttcgatggaagacaaaaacatgggccgttctcttcagtctagtacccagtgaactgtccaggtaattgttttgtaaacaatttttctatttatgaaaatgtgtgctttttcttcttactttctaaaaagctgttggttatcagtttcctggctgggcacaggcgtcctgagtccctcagtgaccgctctcagcgtgctcagcctccgtctggatgcaccatactgtctgccctttcccttgtagagttttctctcagacccaggggataactttgggtgtttcttcccccaaatgctctcagacctgtgaccaggaatgactctgtctctggaactcggtttcctacactctgtctttcccttgtgctttggctctgagggtcccctttggctttcgagacttgccgaggtctggtccagttctaaggtactgctgctgtctgaagcagcacccttcactgctttgtgttcacagccacagcccagcatcacctcgggagcagcctgggctgaggagccttccacgtgttgttaacctggctggacaggtgtgggtgtgtggtgtcatctctgcccaggactcagggatctacagcagagagttagtgttgctgggcacagggtgtggctcagtggcagacagagtgcttgtctagcaagcccaaggccttctgtctggtactgtatctccccagccccccccccccaaaaaaaaagactgaatatgaggaatgagtactgtgggtaactaagttcttgcctgtccaagctaggtaatatgtgtgttaccatggaagaatggcctacaggagccgtggttagggatttgagtgggcaattgttaagtaataagtagagacagaaaactggattgggaattcagagaaccagcattaacccccttacctcgtcagctggagctcccactgagagtcctgggcagagcacaagtgtcccctcaggtcaggaatccacataagagaacaaagagcagcactaaaaacaacatcatttagttcggtgctcacgacaccccagaaacgagctggggggctgctaccatcggtcggtcagcagggttttctccctctccctctgcaggcgcttgggtagcaaggacaggctgtagcgagccctctgaccttggaaaggtgtctgggaataaattacttcccagctgtttcaagcgatgtattttgactcttggattatcaaagtgttttgtcatttgtcataaagtcagggaaggggcacacatccccagacaaagggccatggaggatacgtttgagacaaacatgttccatagcttcttagcttaactagcccttgacatttattgatacagtgtatattacaacatgaatttcaaaaaataaaaaaattaccacacatatatcaagtaatatctcccccccccccattttcaaatctaaaagttagcttaagagccagcctttgttcaggcttcatgtccaccctggattaagctctcagggctgctgcgcccgactgtgagcggaagctgtcttcccagtgccctgggagcctggagtgttgagcaggaatagtcagtgctctgagatgctggcccggtggccagggtccttctcttaccaaattatgtgtgcctcctctgaggaagaggaaggcatgggtctcctatggccctttagtccctcgtgggtcactacactgacataagtcatattcagagctgatgctggctaggccagaccctaaactaaacccttctaaagctgtccaggccccccctttcctggtccttccttgcatcctgtggattaaatcatctctacaaactaagccactgccacaaatgggctgctgccggcaagtggccctggaagggtgtccctgtcagatttcacctgacattctcactacgaaaaagcatgttgtgactgaaaagagagatgagctattctccaagaagcaggaagtgactgagcagacaggttattgaggctcctggagagctcaccgccattcttggcctgcgaataaatggttctttgacctcctgtcatatagcagtagagtgtttcctttctgaatcactagggtagtgtgacctgtgacaagtcagactgtgccgatgtgaatccatgaaaagcggcccttgactggacctggggctgtggggcacagctctccagagtcctgggttagaagtatcctggatgcacccatgtcgagagtggtaatgtgctggtttcataagatagttggcgttgttacccgggcagaggctacatttctggttgagcatggtcgtctcggggcgtgcatgtgtgcaccgtgcagggcctgtctggtcaggagcagacttcatggcaggtatgttacctggctctcgtctgagttgctgaaagatgagctgagagcccagtgctaaagaaggaagaaaagaacaagcaaacaaacaaacaaaaaacaggaaacaaacttgactggcatagtttaggactggtcagatttggtcaccagtatgaagtcaactcctcttgtccgcgtgtcctccattaaattacccttctaaaattacccttcctagttagacccgcatgcttcaaggaaatgatgcacctgaggcgttgggaaggcgctcactcccatgcacttttctggggagagttcatggaaggctgcctagagggacacgtgctggcagtacggagcacgacttcttaagagagttgttgagtccgtggctttatgggatattgtatgatgatcagagtcaatcaaacggctcctcacgttcttgtttactaagtaggggagcagttttctgtt

SEQ ID NO: 17535 - DNA, 1116 bp, Mus musculus
tatcttcagacactccataagagggcgtcagatctcattacagatggttgtgagccaccatgtggttgcttggaattgaactcaggactttcagaagagcagtcagtgctcttaactgctgagccatctctccagccccagctcccactgttaactgcatgtttatcacacaccgtgttctcagtgctggcatgagggcacaagcatcacttagggctcatattataagacaaaggtttctcctcagaggccagtgctcaggataaagtgcttgtgaccccgatggccatagtgtgaaggggtggtctcctacatgcctccctctcccttcccttgactttacagcagccctgggaggcagcattagaccagcagaaggcttggcttattgtcctgatttggaaggctactgtccaagcctagggttttgttcactgtgtggacgctgagactgcatcaagaaatacctaactaacacttgcgtttcttttcagcttttaccgttacgtcttagagccggagatttctttcactgcagacagcagctttgctaagggaccgatagcaaagtttctggatatgccacagtctccgctgtttactttgaatctgaacacacctgagagttggatggtagaatctgtcagaacaccatatgatctggataatatttatctagaagaggtagggatgtaattgttctcgactatcgcatcatgtataagttaaatctatccatcattcagtcagtggcgattcctgaactgagtggtggagatggcgctcacatcacacatcagtgctcccttacgttgatgctcccttacggcagctgctttattcagatgccttcccgctcagaagttgcggtgtgtgcgtggactgctgctcccacccttgctctctcagcttagtcagctttggttgtcctcagagttggtcggctccacgtcagtgtcagtcactcctctcatcctctcctgattgacaggaagcagtgctagggaggggcattcattagggctcctaagaatgcagcctgtggtgctagggaggaagtggcctgatctgggtgccaaccaggaagcaaagagaggagagtcccaagggcttccg

SEQ ID NO: 17536 - DNA, 1210 bp, Mus musculus
cagtgaaactgaccaggatgcagccagccagccagacagacagacagacagacagtcagtcattgagctgatgccctgtagaaagcttagagctctggcacaagcctttcagaatctcctgtatgctccagcagagatgctgctgcgccttctcctggaaatgcgtccttgcattcagatttcattgatgatttattgaactagaaagcttgactatctcacttgacaaaagagtcccaccaacattaagtggccatttgaatcccaccagtgaaaaatctttgcaggcttccactcttccctgcagctgctgccgtccccacgcacctgacccaggccttcagtccccctgcctgcctcagatccgcctgagactatacagtacagctcctgttccccaagcactccagacggtcagggcacaagaccttccggttgacagttttagtcaaagtggcagcatctttgagggccagcgagacgacctctaggacttgtctggaacctgccgttgttaattatctgtcagtttcagtttttcctgttttcccaccagataatttttatgtggatgactttgccagattttctgccttggactctcggggcaagacggctgctattgccaacagtatgaactatctgacgaaaaaaggtaacccacttgggcttgatttggtccctcatgtttattctttatttagtatttacaaataaactccatctgcaactgtaggaaaaaaaacatttaaaatataattctgtatatgtctctaaaaattcaactattttctttaaattttatgcttatcattaaaattgataggaaaagcccttcatgattcaaaatggagaacattatatcaaaatggttttgcctgacttcagtatcatcctaggtttacttttattgtagaacttagaaactggattctagaaagcctcgtgtgactcgttagagtgattttatgcagttacttagttaagctacccttgtccacagtcactgctttcatctgcagcaggtccttccctagagggtagggggtggttgacaattagtatccgtccagagtggttctagcaaagcttgctgctctccaaagcaccggttgtcattaagagagataattttgtccagctgtggtcttccttcagagcctttggtttcctgaggacttataagcttatgcaattagtccactgtgct

SEQ ID NO: 17537 - DNA, 1733 bp, Mus musculus
tggatagttggcatttctaccccaacactgatgtagtttgaccccagtgtcagtatagaacggctcactgcagtttcatgatgaaggcaggaagaagtgggctgtcagctgccagcccttagctgctctaagatgtggggaatggtggttaccatgtgatggctggccccttcctcttcctcacaacattttgtgcaatcgcctgtagaagagagcctgtaggtccaaaaagaggggtggacggcaaaggaagtagttggcaaggcacacccaagggccctatgctgctggcagctcgggcttggagctctgcatgacacttgagggcctaagaagagctagagaaatggaatttaccaagtcagggaaaccgcaaatccccgagagtcttgtgtgctgcctggcaatgaagcaattgaccagctaccatgctatctctgctgttgtaggaagcttggggcactaggacagggaaggctgtgcttcaaagtttgtctcctttcttagaactctgcctttctgcttagaagtggaaaggttgttgactactgtgtgaggctctggggccagcctgagtcttgtagaccgtggtcctggtgatgtgggcactgacgatggagcagagcctctcattccctgtgacactgcagatggagctgatgttcagagccggctcctttccctttcatacttagaaagtttctgttaagatgagaaataaagcaacgcaagtgtgattttggtcacggggccatatacagctacaccaaagccctctcacctatagtctgagtggacacagtgtggaggagcctcaggcaagtcaggtcagagacgtgtgataggacgagagaggtctccagtctccacacctcgccttggctgtggagttgcactcagtggttcacagagtggagctgtattctgaaattcagaaggcattcagagaatttgagaaggtatgaaatctggatgaggcgcgcctagcgctggggccttgatagcttcataggtcagagcatataaccaccaaaagagaggataagactgggagtgtctgtgaaacctttagggattaagttggcagaggaccctgaacaaccctttgtgacttaggagaacaacttgagcaacactggagggctgctcctgaaagatgctgcccctgtgttctggaaccaaagaaaacctgtatcctgctttggtggtttatctgtgtgcatcccatgggtgacttctgaggcatggcttacataccttgaagaactgcaaaactgaggagggggagctgcagcacactgattgtcacctttgagggactgaccaacgaggaggtgactggagtctgtagaccatgttcctcgggtcccatctcaaaccacagcagttggaatgtggagagacacttcaccccacccacctcgtggcagacttgagggtgtagcctcagaaggtagtactcttatgagtatgtggaagggtcaggaaggctttacattctctttcaggcaacagagggcttgtaaatgcccagtggaagaggtcactgaggagcaaagacagcaacctttggttgtatcactataataatttgggttggatgaattcatagaagtgagccagagcaatgtttctgatcttacgttagcaaaaagaataaaatacaaaacattgaactttgcgttgcttcagcttgttttcatttggttctgcatgctttgggaattgcctcc

SEQ ID NO: 17538 - DNA, 1177 bp, Mus musculus
ttttagccaccagataaataaatagcttttgagcactgaaaaaaaagctccatgatttgttgtgacttgcggtgtatggtaaggtgattcattggcggaattgggaccaaaagctagagttcatgctttagcttagtggccttagactttttgtaatgagaacaaaaatatgacagtatctctttatatggtggacatacatgggaaatgtcctcagggttgcattttaattcctcagagtttctgttataggactggctggacagtggctcagaataagctatttaacaagatcctcaaagccctgcagtctgaccggcttgcacgattggccaatgaaggggtaagacattggaagtctgtctatagttgactctcttagttttggcctcgggggttgttgtgtcctgtgtgctctctcccctcagcccccagcttgctcacggagcgtaactcttgttttattctttttgtgaacacctttcaggcttgcaatgagcctgtgctgcgtcgcgtggctgtggacaagtgtgcaaggagggtgcggcaggcgctggcaagtgtcagctgggacaccaagctgacccagtggctgcacaccaccctcgtggagaccctgagcctgcccatgctggctgcttacttggatgccctgcagacactgaaagggaaggtaagactgtgcttggtttgcccgagtggcagcagccagggtttgctgtgagttcagagggtttgcacaaggccctgtgactaggtcagcacagaagctaacaatttggctattataatggaaaaggggatcattttcccttctatttggtataaatttcttcagtcgtgccatttttttggataaagtgtggtatctgaaaaccaggatacataatttccctctatagccttgtagttcttaccttgagtcatcgctgacttgaactgtggtggaagagacgaggctgagcagaggaggaccaagggtaccttctgagttaactctcctcatgaagagatggactgtaggctgagtatggtgctacacacctttaaccacagaactgtacaggcagaggcaggtggctctccatcacttggagcttggtctacactgcaagttcattgtagggcttgagttagtgaatgaggtggagttcttgacacataagccagcatatgg

SEQ ID NO: 17539 - DNA, 1163 bp, Mus musculus
agggatgaaggatctggctcagagagtccaagtggccattgagctctcacttatggctgggtagggggcgaggaggtcgtgctagatggcctgttggtaggatccatgctggggctgggcctcttgtactcacagcatggaagccctaagtaagaggaaactagataggaaggtcctatgtgttgtgtggccacagcctaaggatattaagccagccacaaagtagttgagagatacagacagacagacagacagacaggcaatatgagaattagtggtgtaaatggtaaaaggaggaagggaaagggtggctgtgatggtttgtaaatgctcggcccagagaatggcactattaggaggtgtggccttgttggagtaggtgtgtcactgtgggagtgggctttaagacccttgtcctagctacctagaagtcagtcttccactagcagccttcagatgaagatgtagaactctcagctcctcctgcactatgcctgcctggatgctgccctgctcccacctggatgataatggactgaacctctgaccctgtaagccagctccaattaaatgttgtcctttataagacttgccttggtcatggtgtctgctcacagcagtaagactctaagacagtgacacccccagccttgggaaacaggtaaataaatatgttctgccggtcaaaccacctgacctttgatttttcgaagttgacccgtttgagaacgtcagtttaacaaggatggttattttaaatttttctcagcagaagacttcatgaatatgaaaaatttatagatgatgaagccatcttgatagttggacagtgagggataattaagatgctcttgaggggaggccctgtgtccccaggttccttgccatagaaaagagagcgtgcagttaagtggccagaactgtggtttgtgtatctgtgccctctgatctatgataccaccttcctacacccaggagagcaaaacagtggcactgttggttttctaggacagccgagggcttcccacaacgttgtgaggcccatccaggtgtgaagttcttaccactggagcatctttcctactaacatgcaaaatgtatttgcctcctgtctgtgtatgtaagtgagccgtttgcctgccctcgcctctcactgtggactg

SEQ ID NO: 17540 - DNA, 1318 bp, Mus musculus
cctagcgagtcggcccattgttcagggactgtgttctgtcactggagatttgaatgctaggagcctgcatcctcatggtcatccacgggaacatctcactggcccaggataccaccacagggccgagcagctgtggcatgcctttccctggagtccttccatttccgagtacagagacatggagaaatacctgctgtgatgcctaaattacacaattgggcagatagcctaagtgtggactggacacagtaggccttccattgcattttagaattcccaaataggaaaccagaaccggtacactctggagacccacttactggtctttgctttgcccatgcctctttctacttcaggagctccttggcaatctggatggagacttctccctcacccgcctgtctccctccactcaccgtcctctttatatgcatccttagctaggaaagaagtttgccgctctcattagctggacctggggcttcctgcagcctctcattgcttcagcctcttctctgctgggtggatcctgtttctgactgtggctgtgtcttctgctttcctcatcaaaggaaaccttcaggcctttggatggtttggctaaaagttgttacaactcaagagaagcttggaggagttgacagatgctgtgaggttaactctggaatcatccaggtccaggtgtgcctcagagagcagtgttggctgcgtctggacctgctggagcctgcttagtcgcatgtgttgtgtttgtcctgattctgctctgagtgttggaagtgataagcagctttcttcttactccctggacttggacatggccccaagatgcttggcctcttactaagaagaaacagttggtaatctgttacacatctctgagagtgaaagcccttcatcctctgtgcctggaaaagttgtggtcctggagcagcagcacagcttgagtgcccttgtgtgtcacctattacactgccttattccacaagggccacatgctgctcacctatcttctctgtggttaaattggtcacaggctagtctccctggagggcctggcacagttctctgtagcccgaggaaaaggcttcataaagtagctgatggaaccactcatgagttctggctcagtggccttcttgtagtgtgggcttggttgggggctccagcctttttcctgagcctcaggtgtgtctgctgtcatcctgcccctcctggatggttgggaaaaccctcacccatcccttaccccatccgtccatagacgaggaggaaggtcaccctagctgcaggtgagagttcatctcagccccctgtc

SEQ ID NO: 17541 - DNA, 1099 bp, Mus musculus
cagtgataagggaaaaaggcatcagacttctagttccttaggaaactcttagttctctgtaggtgcagcatgctcccaggtctctagacgaggtgcctagctgtgttcctgagagacctaagtgccaggtagagcaaaaccatgtggtgggtgtgaggcaaccgtagcaggtgcgcacacttccacagctacctctctatatccagtcaccacctacagacaggctccacccatccccacccctcccctcctcatttagaatcacttcttgcagagggccataattgtttccaaatattactggtctgatgacttcctcctcccggtgcaatttttcacttcctcttccagcctctggttcctgggcagagccataccctggaactggcccagtctgcatgtcttcccagcagaggaggactctgcagacggcatccaagtgggtggccaagtcacagccgccatagcagatgactcctatttattttgcattaagattttaatttgtatatttttgtgatttattttggcattgttatgagtttgactctcggggagttttgttgttatgactcttgtgtcttttgtcacaaaacaatgataatatttgctaaacaatatatggactttatttttgattggtaataaaaaatgaaatgtatataagttttggtgagcatataactttggtattttgtttctggactatttgctgtatattgtagagacaagtgactagctgtcacttgtgacaggacaagggcagttgagtattgtagaaccatttggaagggaaatacaagaagaactgtaatttacaaagtatatataatcaaggcagttgtcacaggagttgttgtggagaggccggtgctggcagacatgcagggcaaataagtccgatgtcataggattctgctagtgagtgttggaatggagcaaccaatgaacaaatagccctccttccgctctgggggctgagggctgtttgggctccatgcaatagtaggatggtgtcgtttcacaacacacagaaacgactttgtctatgtcaatggctttggggggttggagtgtccatctgaaatggcagacctaa

SEQ ID NO: 17542 - DNA, 2553 bp, Mus musculus
ctgagcaagccaagagtgctgagttttgatggaagtgttcaaatccatggccctgccgtgtacttcttggcttcccctacaatgccatattttgattcatgtaccccagtttctcatgtgccaaatctaagagcacagctccccaataatctgtgccccggttccgctccctcctgtggaggaagcccctctggctcctcaagtcatgagcaggctggcccagggtcgccttgcatttctttcccacttgggcacggcgccaccacagtattgtcgatttctgtttgaggtcatttgtggaaggccaaaggtcagtgttgactgacctggggccgtggcgcctgctgtacctgtcttgtgctcttgccctgagcacccaggaaggtgtgcagcagtgcaccgtggagcagcagtcagtgaggcggttgtaagcctgcaacgtccttgtcacttgctgagaagtcagggttttctcgtatctctgaaatactcaaactctgtgtgcttttgtctttccagtgatgttttagagacacgggtggaaagattctttctcttctagtttacctatacttttccacagtttcagctctgggacaatagattggggtgggaagggcggatttctggaaccattcttaaaagaatatgggcccttgtgagacttggaagctaagagaacagtggtacgcttgctgaaaaaaatattataacagaatgtactctgagaacaaacccaggttggaaacaaatactttgaattacctgtctccaaaacagaattctaaatttcggctgaacctcagaatcgagttagaaccttggatgcgtatgctcaccttgaacccccagggctgtggtcctgaagtggttttaacctcctcctagaagagtcccctatgccctttaccatcacctcctaaagttaacgtgttagataaccttgttgcatttaccagaactcaaatgttaacattggagtactcaactgaggccttgatttagatctcacttttttttttttttgatttctggcaattggaatccagatgccaggatgcacttggagctgtcgcttctttagacctaactacagtaattgcaggttcataggaagtggcaaagacgcagagcccttgtaccctttatctggctttccccagtgctcccatgtcactaaccatagtgtgcagggctgtggggctctgcactctgccacctctgtagacccaagtaactgctggagaatactaacccgctggactgtccctcggagccacctgcccccgccctaagccctgggaccatagactgttccatagactgttcctcagctctgtcattttgtcatgtcaagaatgtcgtttgaggggctgtgttgcgtgcagctggactttgggattgacttcatccagcacagtgctctggaggctgttccaggtcagtgtgtcagtggctcgctcctccttgccaaatgatgtcccgtggtgtattcagtgtcctgtcagaggacatctgggttgtttgcagtttttggccttttcaaaataaagctgctatgaacattcacgtacagatacggtgtgaagactggtgtccgcctgggatgtgccagcaacacaggtgccatgacgtttaccttaaaaaagaacctgcctggccttggagcggagctgtgcacaagtttaaattcctacaggaaatgtaggaatgatctggtttctccccaccccgacccatgggccaatgaccatcagtcctttgctgtctgtggttcttgtctgcttttccttggtctcgtccatgagcctgttcgtgttttcagcttggcaactggtctgtattcctttccatgtgtctgtgcatctccaccccacccccatctttttttttttctcttgggaactctcttgggaactcttcagatatttagattccaaaatccttcgttggatttttggtttgcaaagattatctgtgtagtgctgtattctagatctgaattgtgaccccagagcttgtatactaaagattgaatccctgggctgctctgttagtgggttctcctgagttcatcagggctctgacctctgccatgttctccctctgtaaagtgtgtggtctaaaggaccaagcagccacaggctcccatgggcctccatctcagtaacattaactgtgttctcaccgcaaggtcttgtacaggtggagggtttggttgggggggggttgttttttgttgtttgtttgtttgtttgtttttggtgttttaagccaagagtttgtctgtatagcccaggctggcctcaaactcagagattcactgcctctgactctcaagtgctgggtctaaaggcatgctctgccacgcctggctcatcttaaaggtttttgtgattaaagtctctctctctctcttttttttgttttgtttttcgagacatggtttctctgtgtagccctggccgtcctgaaactcactctgtagaccaggctggcattgaactcagaaatccacctgcctctgcctcccaagtgctggaattaaaggcg

SEQ ID NO: 17543 - DNA, 1169 bp, Mus musculus
gaaactgatgagaaactttgggatcctgtcgggtactactattcggatggctctctcaagattgtgcctggtcacgcccggtgccagcctgggggtgggcccccttccccacctcctggcatacctggccagcctctgccttctccaactcggctccacctaggaggtggtcggaactcaaatgccaatggttatgtgcgtttacagttgggcggagaggaccgaggaggatctgggcacccactgcctgagctcgcggatgaattacgacggaaactacaacagcgccagccgctgcctgactccaacccagaggagtcttcagtatgaggggacccccccacctcattggcgggggggggtctcatgggaggtgcactcttaacttttgcacaggcaccagctacctcagggacatggcaggggcacttgctctgcctgggacagacactgcccagcatttgcccggccgtgaggacctgctcagcatgggcactgccacttggtgtggctcaccaggacttcagcctcacaggagacacaccctcctctgtgaatttgagacatgtgggaccccagcagccaaaactttgcaaggaagaggtttcaagatgtgggcgtgtttgtgcatatatgtgttggtatgcatgtggaagaatgtgtgtgtgtgtgtgtgtgtgttgtaactttcctgtctctatcacgtcttcccttggcctggggtcctcctggttgagtctttggagctatgaaggggaagggggtcatagcactttgcttctcctacccccagctgtcccaagctttggggcagtgatgtacatacggggaagggaaggacagggtgttgtaccccttttgggggagtgcgggactcgggggtgggcctagccctgctcctagggctgtgaatgttttcagggcgggggttgggggtggagatggaacctcctgcttcagggggaggggtgggcagggcctcccacttgccctccgggttcggtggtattttatatttgcgctcttctgacagggctgggaagggttgttgggggagggaagggaggaggtgggcatgctatggatactggcctatcctctccctgctctgggaaaagggctaacagtgtaacttattgtgtccccacatatttatttgttgtaaatat

SEQ ID NO: 17544 - DNA, 1153 bp, Mus musculus
ccccctcccacccctgcttctttgtcttgccctccagttcctgaccctgtgtctcctagtccggccagtgtcctacacggatgccagcatcttggatctgatggagctgctgtgccgcgcaggcctggatgtagggttgtgcctgctgcccaagactgacctccagcaactcctgctcctgctgctggagagaatccaagagtggcctggaaaggtacacagcctgggctctgcccctgggaactcccttgcccctggagcaccctaggtggggagagcatcacttacagcttctgcaggggtccctggccctcatgaagggacctttgctcccctaagttagcagggcagaggtgacggcagcttcctccagcagcttactgggtgcctctgccctacagctccagcccctttgctgtgccctgagctgggtgtccgaccaccaccacaacctgctggccctcgtgcagttcttcctggatgtgacgcctcggggcaggtgggtgcttctcaaccacatcccacgggatctttcaaggatctagaatcttccataccaaccccaacaaacaaactgtctgcctggtttctaaagtctcagaggaagaactaaaaatacaattcactaatgagttctttacaaatgaaaaaaaaaaaaaaaacgcctaattttcttaacatgatcttattagtaaaacactgtcttatgcaattagcttctgccggcagtgcctgcctgcccgcctttctttggggctcccccaccttaggtttctgggttcttcttgtcactccttccctctcttccaccacccactcctgctcctagtccatcaccgtttattttctgcgcagcttttttctgccataaattatcttactatttatttccctatttggactcactctccccacctagtcacttccagagcaggtgccttgtcaggatcactgccatagcgccccacatctcagcccccgcctggcgggccagtggtgttttgtaaaattcttgtggaatgatgaagtgaacaacagacagcccagaagataagagctgttggctggactctcctggccttgtctctcctcatctccacctttgttctcctgctcctcactcacagccacagggagggccctacctgggccc

SEQ ID NO: 17545 - DNA, 2419 bp, Mus musculus
agggctcggggagggactggccgggggaagtggatggacgtctttcccaagtaaaggaatgtgagatccgaggacccagggaaggcagttggcccagcccacaggaactcaaaaatgttgtctctctatcctcacagaggctccatcctcgcctcactggataccttcaagaagatgtgggtatccaaaaaggaatatgaagaagatggctcccgcgcgattcatcgcaaaaccttctaatgcccgaggagggtggacatactgggagagagggagaaaaggggagccagagcccttgaccccttttggtctgggttcatgttctaagattagggtcccctgcatgccctgaccccggagcaggtggtgcgatcatggtcacctgtagccctcccctcccctccccctgtgctcaacacacacacagacacacacagagtaatgattggctgcatggctggcagtcccaagctggagcatcggaactgaggaacccagcatcgagctggtgtgagtgaccctcttgcagtgccactgtggcctgtggttccttgctctggccttgaagctctgagaccagactcacatgctccatttgctctgacaggctcccaatggggctagactccctggatctctggagtaggctgaagggagggacagccaggagctcccctcagggtggtgaggcacagtggtgtttgatgctgcctcctctttctggcctggcagggcaaatgtcctgcataggactgactaggggacagtcctccatccactgagggaatgcagccaagagtcagagcatcagagccatgggcagccacagctcgtggtttgccccactctctttcaaagcactacactgatttgctactccctcctcgtgccctccgtgccctggacaggaaggggttaatggtctttatttgctaaaggaaagccatttaatcaggattcagacccaaagggaaggcatgtgcttacctctatcaagaaaggtcttcaccatgaccagggcctcccctccctctccagatctgaacagtaatttaacacagttgcctgaaaaatacttgtttttataaatcattatagtaataattatggacaaggcccggtgtgtggctctgattcttggggctctgtgctcttgtttgctcgcccatcactgggagtgctgagagaaagaacactggcagagctcaggagcttgaggcgacaggacaggtgagagcagcctcgtaccctcccactgtgacctgctagggctgctgtgtgtgcctcgcatgtgtgtaccgcacctccatgggcccaccgaggtgtgcaggtgctggcagtgatgcaggcttagcagcttacagcaggagaagaagaaggagaggcagcctgagaatggaccaggctctacaggaagaaacagaacaatctgcaggagtcctgcaggcagcaagtagagaagcttgcttgttagtgtgtgggtgcatagtgcacaacacatgattgaggctgatggaggaaacaagatacaaagggctcatcataaaggagaaagatgccagccagtttggaacagtgttaggccgttagggttagggctgcaccatgctgccttgtaagagcttggtcagtggttagggagagccctttgacaggctggggagggacagttggcaaggaaggtaaattggtctgtggcacagtgacataaaccaaagaggtcagatggactagcatgtgggggatctgaagaaaggacattaaccgtttgctaggtgacaagttttcactgtggaagagtagtgagcagagccaagtgttgaaagctataggccaaagcactgatcaggaatgtgtgcagcagatgctgtgcggccatgtggtcacagcatcaaagtttacacagacgcctgtgctaaggggccctgcaaaccagctcctgtgcagggtcctgctggcaccatgggctcccagccacccgtgtttggaaccttcctgctgagctcctcgtgcccacacttgtcagtctaagtctatgctctacagtatcctgctacccatcctttcctatcggggccccagcctcgcccacgaccctgctccttcctgcccacccagtgtgtgtgctcataatctactgtgcgggtaaccacctcaaatctgtaatgatttataagccatacaataaaatattcatgagtccttatgagtaaatatagccggggggggggggggcaccagctatctgttgagcagaattccagtttctggggaaataagccagccggtgtgatactggccaagtcatttctaggaaccacaggctgccacatttgggttcttttcagtccctcccttaagcatccccatacccctctggcagggatgtcctggtaaaaggcagcctgttgtaatagaa

SEQ ID NO: 17546 - DNA, 1221 bp, Mus musculus
acacacagcagctgtgtgagtaacatatcttctgttgttactcctccttccagtttgagtgccgatgtgacactgaaatattgtaaagttttaaagcagctctgtagatgtttacagtcccaggaatcctgagagccacagccgcaccttcagcacccgggcctgagacaaggaaccttgctggactgagggcagtcagcctgcgcacttcatctgctgcaggtttaccctggaaggaggcatagctccctctggtcctcagtggcctcagctgctcatggggtggcagtgaagagactgactgccctgccctgcatttggggagcaagtgcttgtattccctgaagcccacaggcaccaagagatgcacatttcccccttctccttagaacctttaagtggaatgcataagtcttcatgtgtctgctttatagaagcatttgaatttcacatcaaaaataactaactttgaaaagtccagatgaaactgtcacattaatgggaccttttgttaatttccagctactgacagtctttataaactgtctctgcaaaccctcaatgcagacattttcttaaaacaacgccagacctcgccaacacctgcctctccttctctgcccaccgctccctgcccgttcacatctcgtggcagctacagcagcgttgtcaacagctccggcaggtaggctgctcacctctggtcatcacagtgacacatagaccccacgctcttgtgcctgctggtgtgaacccattttcattattaaaccccttacctgggacaagctcttcctgtgttccaggtacctgaccccagcactgaccttatcctgtctgtgaacaagtctgttactgtgttcttgagctgtgtggcaagcatcccacgacggagcgcttcacctaaagtgttgagtggagtgcatgagcaggctgtgacatctgtgtcactgccatgttacatgttgtagagtgacacactcctccctcggtgccagcaggcttagtatcacacaggcaccatgtcctccagacaggctcctgtagagaagtcaggaagctatgaccgactgggtgaagggggtttactgactggggacccccactgtaaccatgtctaggggacggagccctgatgaatggacttgtcccaccagccccaccattggctgatattctcacaggtttctttgccaagggggcaccttcaggttcttcaaa

SEQ ID NO: 17547 - DNA, 1141 bp, Mus musculus
cataggtcaagtaaagtaggctctactttgccagcccctgccaagatttccatgcccaggtgaggagttagcaaggcattgtttgagataaattcagaagtctggatcgaagtcaagtctgaagtccctcttttcactcgtgtgttgaaaagggagccacacacacacacacacacacttttcaagtgtgacctctgcaggtctgggtgctgctgctgaaggctcagttggaggtggtagaatcggagctttccaggcctgtgtacagtgtcagctccatgccgcaaggattgacttgttcagtattgtattcctggctcttggaacatggctaaggctatgctgtggttggctctgggagcatctggatctcttaagtcactaagctttctgttttatgctgtccttagtgacactgtgtggccactactgtcctaagggctttttgtaattccttactttagccctgcagatgatctgccaggattgggcccagctggggtgttagcaaccccaggtgatgcaccgccaacactccatctcccaacacatgaggctttgcctttctctgttgcgactctttaaagctccatcaccttttggcaaacattttcaggccagtttgccagatctgcggacaaacttgccaaactgtattgtaagagtatagtccattgcacaccagttgtgtctcaacaaagttgactttttaaacaacctcctcacaaagacaagcctgacaggcagctgtaagtcaagaaggaaaaattggagacagagtctagccgctcctaatagaactaagaacagctctatgtttgaagctgtttgatcaagctctgtttttactccaattttcatccccagggaaaggaaagtctctccaacaacgtaaggccaagcctccgaagaagcaggaggagaaggagaagagggggaaggggaagccgcaggaggatgagctgaaggacgctctggccgacgacgacagctcctccaccaccacagagacctccaaccccgacacagagccactcctcagggaggtatgtgggcgttcacagtggggcctcagactgcctagctcagtacacattaatgtctcctgtgtcatgtctctcctctgagcatgtgtcctgtg

SEQ ID NO: 17548 - DNA, 1141 bp, Mus musculus
agtttctctttatgatgggtttactaatgaaatttttttcttagtattaggttggaagttactgcttactgatttttcaattgatccatttttcagcttgaacacacttggctgcgaacacagtcatggtaggggtttctatagtaacgcatcatcccggcctggtacaggcagtcacaggcagtgtggcacatcagtccacccacacagcagccatggcagcaaaaactcagctgatgtggacaacgtcagaaccagaaacagttcaagtatgtcaagcaggacttctccacaagcagctgcctcacagtctacaagcaaaaccagccccctagtctcagagacagctgcagcaacccagggtcacacagcaagcaggaagtccagaggggcaaagcagggccagcacagcagccagcaccacagccacagccacagcccactggagcagcactcacagcctccaccaccagtgcctcagcaccaggagccaccacccgaaaggctgtctcctgcccccctcacacacccttcccaccccgagcgagccagcaccacacggcacagctcagaggactccgacatcaccagtctcatagaagccatggacaaagactttgaccaccacgactcctcccccctagacgtgtttacagagcagcctccgtcaccgatgtcaaaaagcaaaggtaaccctgtccaacccccttccaaagaacaaggcgtgtgagggagaaggagcagtcaggatcataggcagtggatacagcaccttgttaggtagctcagacccatctcctgcgggaagcaatggcctctctgtatcacagtgcaaacggaagcaactgcttgtcatgaaacttgttcttcccttgtttctccagacagaatctgatggacggctgccggtgataactgttacagtcatttttaaaaattattttgaggccaggtattgctggcacatacctttaatcctagcactcgggagacagaggcaggaggatctctgagttcaagacctgcctgttctacagagcgagttccaagacagcctgggatacacagaaaaaccttgtctcaaaaaacaaacaaacaaaaatattttgaaaacagggctaaaaccaaaaccatctacctc

SEQ ID NO: 17549 - DNA, 1196 bp, Mus musculus
cacatgctttcagccatcaggattccagaagcaaaaatagtgtttccaaatgtgcatacctgccttctggtcctgagcgtgtgatggatgctaagagtcccaggccttacatcagagctgttccacttggctcttttgcaggtttattctgaatgtgaaaagtaaaacataccctttgaccatggcaggtcagagcctgacagggaaggccctctgtgagcctaggctgtgggaggccaaagcaagggagcattagttctaggccatcctaaactacagaacgagttcggttccagtcaggagtactgacagagaccttactgcccaaaaatacatatatgaaactagttaattatcaatacaatggcagaccccagtggattgttcccggatgaaaccttatgaatggctggtctttttggcatgtggggtggattcataatgtccagcatacagaagctcacaacatgtttacactggaagcacataatagcaagatttatctatatttgtgattttttcccctctttaggtttgaaactaagagaaccaaatttcacattgaaaagaacattcaaagtagagaatacgggacaacttgaaatccgtgtagaaaccattgagatcagtggatatgcgtgtgagggatatggttttaaagtggttaactgtcaagagtttgccctgagtgccaacgcctccagagacatagtcatattgtaagtacgtccttgtctggctcaccacagagtggagctttccactgctgctagagtcagttcactactgcatggagatgcatttccagacctgaagggtctttacaggggctacagagatgagcactggctgctcttccagaggagctgggtttgattctcagtacccacatggtggccaacagccttctgtaattccagttcctgaaggaatctgtcttcttctggccacttcagggactgaatgtggtgtacagatatacatgcaggcaatattttttaaaagtctatcacaaatgtatttattttattttttcctacctaacatcaactaaaatattccatgtttttgtttccagcattgtaaaacttcctctgcccttaaattggatcagataatcttagcaactactttttttagaatccaatttcagtattacttctacggttgtaaagcctaagatgttagtgtgactt

SEQ ID NO: 17550 - DNA, 1147 bp, Mus musculus
tctagtctgtggctggtatctttactatagtctctagaaaactttattattattattcactttaatcatatctgacttttctttcagtttatggctgtgcaggcttatgttcctgcattacagcttcaaacctcaggctcactaacattttctcctaggttgatttctagttttagaattttagctctcacataagctttagtgttgaagttgatgcctataagtactgagctctggaaatttccttgtctatatggctattcatcttcgtatggttcattgaaaagattattttcccctattgaattgctacatcttcatcaaaaatcacttgacctcatgaggtggggtttgttttctgaagtctgtgttatctgttgtgtttatatcagtgttacaactggtcataatgactatggctttaagaagccatgagaagagttaagacacccactctttttttgacttttttcaaaattcttttaggttctttactttcccacaagatagaatcatcttttagatttctaccccccaaaaagcccgttaagattttgaaaataaattttatgttatttattatgtatgtgactatggaggagtgcgtgtggctcctacatggaggtcagaggacaccttgtggacaggccatcaagccatcaaacaccctaagctctgagcgtctcactgcttcccaaagctctgaagtcagtactgcatttctaggtaacaggtgctcctggcgtttacatactggtgggctgcatttgcatataggattgcacagatgtggcagtgaccccagcttttcttgtgtctttggatgaatcattgattcagaaaggggttggggactttgtattcttctggcttctagtagagttcatttagatgattttttttttcttttgagagagggtctggagagagagctcaacagttacgagtagtactgctcttcaagaggacccaggtttggttcccagcaccctgtggtggttcacagcatctgtatctgatgtttccttctgatctggaaggaaacaaggcatgcacatagtacacacacatagacacacacaggcaaaatacttaagacacaaagtacaacacttaaaattaaaaaatcatatttggagaaattcat

SEQ ID NO: 17551 - DNA, 1168 bp, Mus musculus
cttgttttgagactggatttcgctgggtagccaaggctcacaaccctcttgccttagattcctaagtgctggatctataaaattgttggaatagtaatagagatacagaatagaatccaacttagaggagtcaaaagacaatagttgcttttcggctttcggctcggaggaggctaaggtgcatctttctttggtcgtcccgaatccgggttcatccaacaccggttgcctccatcatgccgcccaagttcgcccccaacgagatcaaaatcgtgtacttgaggtgcatcggagaagaggtgggcgccacatctgccttgacccctaagataggtcctctgggtctgtctccaaaaaaagttggtgaagacattgccaaggctaccggtgactggaaaggtctcagaattacagtgaaactgaccatccagaacagacaggcccagatcgaggtggtgccctctgcctcagccctgatcatcaaagccctcaaagagccaccaagagacaggaagaagcagaagaacattaaacacagtgggaacattacttttgatgagattatcaacattgcccggcagatgagacaccggtctttggctagagaactttctggaactatcaaggagatcctgggtactgcacagtctgtgggctgcaatgtggatggccaccaccctcatgacatcatagatgacatcaacagtggtgcagtggagtgcccagctagttaagaagcaacaagaaaatatttcaataaaagactatctgataaccaaaaaattaaaaattaaaaaaattaaaacatttaaaaagacaatagttacagaagagcaccatgggtagtctttacggtgatgaaacaggttggtgtgttgactgtggtagtggtcacacgaagctctgtgtgacaaattactcagaactaagcacacagaaagaagactaaatcaaggattggagagatggctcagcaggtaaaagtgcttgcccagcaagggtgaggtccagagttcagatccctagtgcccacataaatgcttggtgagtgtagtggcactcctgggattccagtactgagaaggtagaggtgtgaatgcccaaagcaagctcacgggctcgactagtgagctctgggttcaaatgagagacactgcttcgataaata

SEQ ID NO: 17552 - DNA, 1196 bp, Mus musculus
tggaaaatcttttaatgcttttaaaatagatccaacccagaggccatggcgatgcatgcctgtaaacctagtgcttcgagcagacagcgaaatatcagcagcattttgattattgatctgttcaggttttaaacttgtacatatagattagattcagcagcagcactctaactcagctttgtctctttggctctaggcatataggaaacaggcatgctccaaggtcatgcctaggctgtccacgagcacctttcaaatattcaggaatccatcaaacgagtcacccaatggcactggccatctccacagttcaatgtcttctgctatggccgtgttgaccacaaaggctgcacaaggtggaaggaaacggtgactcacaaaagttgtcctctgatcgtccatgggggtttcaatacatatgcaccagcattcacataaacacacaataattaatataatgataataataacaataatacattaaaacatgaatttaaaaataatacatgtctatggccataccaccctgaacatgcctgatctcatctgatctcggaagctaagcagggtcgggccttgttagtacttggatgggagaccgcctgaaaataccaggttctgtaggctttttaaaaacaaacaaacaaacaaacacaaacaaacaaacaaaaagacactctctgtatctttaagggatgacaggtagactttctaagcatctaaggatagaagttcatcaatttagacaggaaaaactatatatatatgtatttttttttttttagtaaacttcaaatgttttgtacatttccaatagattacttttagttttttttcaagttgaaaactggcatttccttcatttaggaacatgatcagccagctacaggggaggatagtggcaggcagctcagagatcattgatcacctgtttgccgcatatgtctcgagatgttgtttatattcattcttactttccaattgttagattttattatttgaaatattaataaagaagtacatatattattttgaggggcctagagagatggcttaacatctaagaacattttctgctgttcttccagaggaccagagttcagttcccagcacctacactgggaggcttataaccacctgcatcatctccaggagatgtgacactcttgcctgacctccatgaatactgtatggac

SEQ ID NO: 17553 - DNA, 1165 bp, Mus musculus
cagattctgatgaaggacaacctaattgatgaggacctagtcgcggccagggtagataccagggacgttgaggagaaggtggagtacctggagtcgtccctggacatcctgcagacgaggtttgcccgactcctggctgagtacagtgcctcccagatgaagctgaaacagcggctcactcggctggagagccagatgaacaggaggtgttgtggcttctcacctgacagggagaattccgaggatgcttcaaagactgactgaaaatgcaggtggctctgcctcctgctccccccccccccccccggggccagctctctgggcgacactatatagcctcggggtaaagggtttggctgtggtttcgcctcagtgctactcatcctttgggagtggtgtgacagcaaggaagagccttagtttcctctcctatgaaatgggactcatggctgtcggccccagaagttccagactatcatgaggtggcgaaggttgtggctttggaaagcgtgaagagttcccaacccagtgtataagcatatgtgcacatgattctaatgttgttagttatgttggcatatgggtatgttcagttgtcggcggaggtcaggagagggcgttgcatcccctgggctggagttacctgctgttgtaagctacccagcatgggtgctgggatcctgtcttcattagggttactattgctgtgatgaaatatcataaccaatgcaagttaggaagaaaaggtttttttttcggcttacactccacatcatagtccatcattgaaggaagtcagggcaggaactcaaactgggcaggaagctggaggcaggagctgatgcagaggccataaaggggagctgcttactggtttgctcttcttagcttgctaagcctgctttcttatagaacccagaaccaccagcccgggagtagtcctacttgcaatgggctaggccctccttcatctatcattagttaaggaaatgctccacggacttgcctacagctggatcttagggaggcattttctcagtcatcctctcagatgactctaacttgtgtcaagttgacataaaaatccgaccagcacaaatccaaacgtgtagtccttcccatatttattgaggtgaaggtcctgctctgttacccagtccagcct

SEQ ID NO: 17554 - DNA, 1145 bp, Mus musculus
gaggatgttcttgatggctgctgctcttctgtttcattttgtgtaccacaaccctgacacccaaggtgcagtgactcagaagacagacagacactcaatgaaaaaaaggcagtatgaggaaggacataagtgtgtgtgctagtcagctgtgcactgtggaccagcccagcgagtgtgtgtgatacacaggcttatgtctgcggccttgatggagtctccacaccgttcttgtccttttctgtaatttttatcagatggttctgcccgttgatgaaagcttgactgaggccttgggaatccgatccaaatatgcttctttgcgaaaagacagcttactgaaagcaggtaagcagcttcctttcatgtgactggccaccctttactcccacccactttgattggcacactcatgccccaattggcacctatctgctgttcttcatcaatatggcattttcggcagtatgcagagccagaaatcccttgaggaaggggctccatttcactcttattagatattgactttagtgactgaccatgttccttgctgttcagagttactaccatcgtctgacagcaaggagtgtcaggcactgcttggaggggcttgctttatgtgggtttggggttttgagttttgttgttgctgtttgcttgcttattagttctcttgggaaaacagggccatagagtcactgagggcccaaggaggagcggtgcagtgggtctgcagccgtttcacccacagcctatcttcttgcattcccacctcagtgtttggtggtgccatctgccgcatgtaccgcttcccaactactgatggtaaccacctacggatcctggagcagatggcagagagcgtcctctccctgcacgtgcctcggcagtttgtgaagctactgctggaagaagatgcagccaggtgaggccaagtggatggacacttaccactcatgagcacgtgcctacgacaggctgagtgcagacccaggctcttcccttgctggccccatggccccagccatctgaagcctgtttgctcctctgacttacagtttggcgggcaagaatttacggggctgagcttgaagccccagaggcttggctaacatcagcctatcttcccttctttctctctcttttcc

SEQ ID NO: 17555 - DNA, 1102 bp, Mus musculus
tacttgatattctcatgttcccaaacccacccaccataaatctagcccttgcattctctccccaagatcccctgatcatacttggaggatttcccctgggctggattcctctaaaagagtaagtaaagtctaagagccgcagaagcagttagtagtgaaaaccagatgccagactgaacctataaattgggctgggtaagcctgtcctttgcagatccgagcactgcaggatcccagggcaggtctcacctctgtgtctccacataagcaggtctccatgtcactcctagtataagcatagtgacagctctgttgcatctttcagtttagtgtctcacccattgccagctgacattagtcaccagacagacagtcaatgattctttgatagatgcccttccacctcaaagcatgtgcttcaagcctctaagaccattttgtttgcttcatttgcataggggagaaagagtccatagcttccttccatctgcattccacggcctcctggttgctaccctcctgatactatggagatgactcaggaaggcatcatttccagggttgtgctgtggccaagcagagagagaccatagacagtgagggcggcctgcagaggaactacagagacagcaccctctgtcccctagagaccaggatgtccatagctctttgcagggactctttctctggaccattgtatagtaaagagaagcaatggctggttaaagaaatcccccctgggcaggggggctcctgtcaggactccatggtctactctgttgtgccagccacccttctgtcctacttggccttggctgaggggataaatgggtcagaaaggcaagaagtggggttccttgttcctcctccagggctgagcagaatgcagcacagcaccccaaaaggcaggctttgagaataaaccccagcactgggaaatttgcatttccttttttccctaacatactaggaagaccgggggaccaatctgcagtgtgttcttctttcatgctgtattttaatgttattaaggctttttgctcatgaaatcaagccaaatatctattcagaatcatgtctacttcagcaagaaatgaggaga

SEQ ID NO: 17556 - DNA, 1192 bp, Mus musculus
gtcggcgagaaaacacaatgaagaatgttggaagtcgcaaatatgcatttaactccctgcagctgaaggccttccccaagcattacaggcctccagaagggacttacggaaaagttgagacatgaacacacggtttcctctaattagctgttacgtaatcaatgtgggtccctgtagtgtcacataagattcttcaagaagacctgaaggattggcttttatttttgtgtttttaaagacacgtcactgaagagtgtatggagcatgattttgtgctggaatctgtagggtcacatgtgggtcaatagcgtggatagtaatggctgctctcaacaccagctttcagctgtcactgtaccgttaatgtcatagttcctagatgccagctaggtctgctaaaactccagcagacttttcaaatatccacttagccctgctcaccccgtttatttttctattcagtaactcacaggtgagcattgacttaaactctgctttaaaaaggactgaatataaaacaggaagtacctacccccttacacttcaggtccttggtagaacagtagatgttaactcagcttgggggaaaagaacctccaagctatgagagaggctggttctagtggccctcaaaggccgccaggttctgtgaaacccaaagtagaaagaaagcttggttggtcatatcaggagctcacacacctggggccacactgttcctgccccttacaagtcatagatgagtgtttgcttgagatgtaaagccagctgtgaggtccctggacgctgcttcccaccccacctccacccctgtatgctccatgtatatttagctctaccccacagggtgtatctccctttgttctctggcaatcaggaccttcaatgtggcttgtcatgggtctgggagacaactctccagatggagatttagagccggagagacagtcgaaacttagatattttcagaataaatgtgcttctgggaactttctaataatcttccagaggctgtatattatgtttgaatgtctagagaaagggtcttagtttctggtttgcaatgatggttaagtctcccttctgtttcacagctattgagaaacagttaaacctgtcccctaccttgagagtctaagaggagattatgggacaggaaatgagggatttcatacactttagtctgttcatc

SEQ ID NO: 17557 - DNA, 4113 bp, Mus musculus
ggctatagagtaaattcaaggccagcctggacagcttcgtgagaccttatcaaaaaagtatatgaaaaggacagaatgtagctcagcggttgagtgcctgcctaacatatgtatggccttggattcaatgtatagtatagtatagaaaaatagataatttatgtatttttacaaaggcttacaggtgctttacctggctgtagcattagccacatgctcagccgagtttcttctttcataaagttactgacgacccttaccagagctgtgcttattattccagatgtggttaaatgcatgcatgcttcttttcagctggatgccagatcaagattcagagggagaaaaggatattgataacatgctgaacgcaagatgaaagtcacccaggattttccatggtccttaacagaaaggaaccaaacgggaagcacagcagctgccgcatctcttccacctctgggccaggtgttcctcccaaggacaccagagaaaatggatcagtgctgtttctgaatgagtctgctggctgaagtcatttatagaagatccatgggactaaacaactatgggctaagaatgtgtctggggaattacctaatgaagagattatgttcaaggatgactcttcgatcagattacacagtgtgtgaattcaggaggccatgatgagattggcatagatagtggctcctccaactcttttttctgtttcttggtttcaattttaggccaaccccctcctcataaaggggtgaaatcagccatagaccacatcctcaagatatgggtgggctccaaaaaggagagcataggctggcccacaagtcacaccctgctgaaggacgctgctccttcctgggtcatatgcttggtgatcttggctagatcctggtcgcatgtactgtgctgacaccatgcacaatcacataagataagttatgggcctcatccctaaacactggaatgcagcaaatggacacaacagatgttcactctagataacaaatgtcaatgacatgaagtggctggaaaagtttagaatccttaacatattattttgaccacttaacacagtagaaagccatcagggcactaaatcttcagtgtgattcttgccattgaacagagtggcaattctatattgttctgtagttcactggggctaaagcagtcaaggactggaagttcacttgctattttaaaagtttttgaagctatgaggattccctagggtgtcactgaggtctgctctatgtactgcccccactgggagtaggaggtactgcacccttgtgctctgtgtactgcccccactgggagtaggaggtactgcacccttgtgctctgtgtactgcccccactgggagtgggagtattgcacccttcagtcctgccacctatgtcccaagcttggtgtctgtgtgcagtgtggaggagtgcacattctgcatgctaggaagctcgaccattgagccacaccttccactagtgcttcagtttcaacagagagtgaaatgtgtttgtatgaaatgcctccatttgagtagatagagctttatttggaaaaagtcacatgtctcataattggactttgacttagacaaccccatggagtttagagtgttcgtggagcatgctgcagtcaccactatctacttccagaacagtctcatcctttccagaaatgtaaccactggtcagcactctgccctctccctctggtccaggtctattagatgagtggaactatgtagtcctgtcttttctgagtcctgttaccaaattcgacaggtttattggcatgtagcatcagtctgcagtgtagttctgctgagtagcatccacagtagacagacactgtgtatttctccatcgagcagatgagctctgagctgtttctactttggggcttttgactaatgctatgaacgtttcatttaatacatgccttagagttgaactccaaggtcgtatcatgacggcctcaattatattttctacagtgattttaccacatttcatgctgtcatgggatctaggctccagcacccctgactttcacaactgctcatattgctgacagccattctgcttgtgataaagaggcatctattgggatcttggttgcatttctctagtgtctaataacctgagcagtttttcgtgtgttcattggctctctatgctgcctttgcagagtgttttctagtctgcagtctggcttccagttgggttatctgtttattttcctataagattttttatttactgttggctcaagtctcttaaagattaattggcatttttttctcaacgtgtttgtccttttcaatctcttgctactctatatagcacagtctttatttttatacattcccttatgtggcttagcccaggctggccgggaatccccaaagcgcgagcattttcagcgctgcacttcccagaaagcacacaccgctgctcttgactagagcagttttcatattggaaaatgacaatgtcttttttctttcactctaagaaaccattcctaacccaaacttccagaagcttataaattttacctcttacctgtaggcctgtgctctcaaaattattttacacacctttattcatgaccatatttgaaattagttaaatagaaataatacattttagtatggctaagtatgtagctccgtatatattgtgttcagcacattcacagtgcagtacagtacagtctgcctgccgcactgttctgcatccacctcaggaaatgcaagtgtgcccatctgaggactcccagccactgccaggtcgcccgccctgccctgtccttggcatactctctcctcatggtaaccaccattctctttcctgtttctgaatttgagtaccctaagtgcctggtatatgtggactctttgttgtgtgcatgcacttgtgtgtgtgtgtgtgtgtgtgtgtgtgagagagagagagagagtgtgtgtgtgtgtgtgtgtgcctccagcgcggaataccatgaaggttcatatcatatatcggtttccttcctttgtaaggacaaatggtattgtagtatatgttgtatgcatattgtatgtatcttgttacctactcatccagccgtgggtacctcggttgttcccaccctggagctcctgactatgctgtgaacgtgtatatacaaatacccctaggacccgctttcagtcttaacatacatgtagcagattgtatgtcatagggtacttctgtttttattagtaggcattgccatagtttccatatcagccacactattctatgttctgtccgcagtgcacagagattagaactgcctatgtccttgtgacttgtatgccattctagaagtcgttaagatccaccagtgcttctgcttcctagttccctgactgctggtgtgttctagatgcttggtggctttctttatatagcgtttgaagaaattgttttaggtctcctctgcccgttaatagttgactctggttgaatttttggtcatcacatctacaaaagcattgattccaagggagctgactgtagcttgccctgggaattttagttttagttcttagctttgccctttgatgcattttgagttaatctttgtgtgtggtggaagctctgactttctactctccacatgtgcatatctagctttgcacaatgccctttggagggaaaacatggcgccatgcatggtggggccggttttgagcccagtctctcctgactctgtctgccttcatgccaacgccactgctttgattactggagaattactatcaaaatttgaaatcagaaagtgtttgttctaaaataaaaatttgaatctgaaaacatctttgttctgtttcaagattatttggggtataactctttgagaatctgtatttcaggatatacattttgtctatctctaaaaacacaaaagtgctgttggcatttgaatagggactgcattaacctcctgagcacctgggtgcattgacatctgaacgtgattaactcctcaatcaataagacacttactggtgtctaatcacagcaaaactgtcaagttttcagtgtagtagatttttctccttttttttcttc

SEQ ID NO: 17558 - DNA, 3643 bp, Mus musculus
ggtttcttaactcgaagtacttttataatcacagcaattctgaacaaaatattttcagaggcatttgtcattcctaaaaatcaagattttaaaagaccaatgttctctcgagggttatattactgtactgtgtatggtgtgtagccacagaaaaccagtgtgactgtcattgtccaggtgggaagcccctgccgtgtctccacagactccttttcccgttcatagttcctttcatgtgggtgatgagactcccttcccttttgctctgtctttaatcagtagttagacaaactgtctcttttctccctggttggtccttttctagatctgtggtaggttttggagttcagatactgttttctgagtaatgctgttgggtgtgtcctgttgggtatgggactcggagaaagacgaccgtagcacttctgtttccatagcatgatttgctccgctgtgtcatgaacgtggaggtaaatgctgtgtccacagagtgtttgtgcatcctcactttgcagtcccaagtagcgctagttggcagaagtgctttactcttatgattaggaaggccgagcaacagttgccagtcttctctggctctccagaaactgcgtgtacagcaggtgtggtggaggcctagggctgtgggaggtcccggctggtagcctccgtcgggggctttcttagttgcccagtgtatgggacacacagaactgagtggaagccattttgtatgttctgcctgggaaaatgtagataaacactactgtgcatgtcaaagcccagctgaagcttttcttggtgttaagtttcccctctcatttccttcagctttttaataattagtactgcatttggcacttttcctatgccctgtgcccacaaataaatcccactatcttcccacactcaagtgtgcagcagcaggataacagactgtgaaaccatgcagatgggcacaggggccccgttaggtctctgctttctcagtggttgtgagttcagaaggccaagccttgaaactccactggaccgtgtgaatgtctcctgcgtgggtctttgagcatatccacttacaaggctctactcatcagtcttgcctctaaggactcttttagccaagtcctttccttcattcaaggaattccccctttccccatgagctagttcctggtgcctggaacacgcctgagccttggcaggctcggttggcatctggattaactagccaggttgctcacatctctctcctagcgatgtctgcctactatcctgccgtgcacgggcacacacacactccgtgtctagtcttcattgtgtgtggtgtgtgttctccaatacactccaggctctggaggccagctctcctgtcttccatcacatcaggcgctctcctgctccctcagtgccagttgcttcctcctcttgtgcccagttcagcactagactattggaaacagatgtttccaatagattttgtgggagccctggaggttgatgaggatgaagacgggggaggtgaagacagagtgcttagaactgtaaagtgttcatccacattatcccttggaggccaccaaccgactttcacccacatagtgaataggaaaagtgtcaaatgcagtactaattatatctgtgaaataggtcatagttggtatcggtgggtatttcacatagcccagactctagagcagtgctggcctctacagaagccacaaaacacatctgttgaaatgaaaagttgagttggcagcctttggagtgctcagtggccacatggccagcagccaccatattggatcctaggaatatgggacatcgacatcacggtgggaggttctgctggatgtgtaaacatgagcattctagaaaggagtagtaatgtatcctgctgctgtggttaaaaatagacctatggattcatcgtagtgcaggtgaaggtgtgtgttttggtgggacagtcaagattacccggctacatgttagtgtcatccttcttcccagcatgcattgcttcgggatcctcaagaggtacgtttgaaaagcatgagaagtgaatgcggatggatggtttcgcttgtaggttagacgtgtgttatgtccatcagagtgtgtttgaacaaaggttcttgaaatcattggttcttgaaatcattggtaaaaagattaggtgtgcttatctcaaaagctatcaggaaagttgggagactagacttctttttaagtctttcataattacgagaactacagttctcaacagtgctgtccctcaaggaaaagttggcttatgtgcaaagtgttgttgttggcaaaggttgttctagttaataagtgtgtatctgtcacatgcaggattctaagaacgacccctcatgaccttgtataatatcctccccttctgagtgtatcgagaactgtgaccacatctgtgggtgattggcccaatcttgagagccatgtcaggctggcagaagtgagagacatcagcagcagaactctaaacagcatcgctggtctaagtggaaggggctcccctaaatgactgcaggtcacctgccttaaggagccagaggctctgttacccaccaagtgggacctgcagaccttttgccataggacaatttgacccagacacttacccaggcttggacatggaaatccttgagcagccagcctggtaaacaccttcactttagctttgtaagtgggaacctacctagacttctggtgtgcagcagtggataataaacgggcagtgctgtatgtggctagatttgtggcatttttaaaaagcaacagaatctgtcagtcctgagaagtctccatatatgattgcctgcggtagactagtttttaagacaaggtctcaccttgcaccccaggccgattctcccggttctgcctctcaagtgctgatgtgtatcaccatgcccggctgactgatggtttttgacataagaataaactcattcccagcaagccctattcctgggtctctgctaggatgtttggtgccaggacccgtgtctcctctacaagtcagacttgtattagtttttgttctgtaaaactaccagggtgaggctgtaggcatctttttctcctagatgctcctaaattatactgacttaaaggcctgccagaagtacaggaaagaatgatgaacggtattttagaccagactgatggagaagaaaaattcccacctttgtgttgacttgctggtgtgtctaacctgacagtgcagcgtgaggctgtcatctacagagtccatgctcaagaaccacatggtgaagttacaaaaacaaggacactgttaaaagctctgagtaagtttacaatcttgtattgtgccattcattgctgtcccgggccacaggctgaacacacctgcaagagcttcggctgtgacaggtgtaattttttacaaaaatcattcagctgagtagctcacggctcaaaccctgtatgttcccaccaaggttttgtgtttacgtggttcctaaaatacctgcacttccaagctattaactgctaatgaggtttctgatcttggttcactcagccatgcttcttattaaccatgctgccacagccttgaaggaaaggaacccagaggttaaacactgtcctcatcctcacg

SEQ ID NO: 17559 - DNA, 1303 bp, Mus musculus
taaccctctggtcacttacttctctagcatcattgatttatgctgattccaggctgataatagttcatcccatgagtctgtcaatgtgtgtagaaatgtaaacagtgaggtgccacacaggaagagtcgtgagttcagtcggaactcaaacacacagtgttgcctgtcattggcatggattcagcacagggtcagtgcgcccaagacttgcttttctctctgccccagcatgcagagggccggggtgtcatctccatcaccacaaagatacttataataatgatcatgataaccaagaaactcaaacgttgatctaacacagatagtatatgaaactggtaacttaatattatgctttttatagtctagcatcctgggtatattaaatcataaagaataaaatgctcttaacctttgttttacttttagtggaaatttaatggagccaccatttcagagccaaaagaaatttgggacaaactttacaaagctggaaaagaaaactatccgaggaaagaaatacgattccgattctgatgatgactagactgtgctgtactttaaaaccttccgtctgtctgtctgtctgtctgtctacttcagagttaagtgtgttttctaaattcctaaattccactgatttcggcccattgaccatctgacactcttatcccagcctgtacactgtttgaccattttgtctgcagtcattgtgtataacttgagagaaacatactttaaattacctgggagggtctgaattctctatttttgtgattgattttatcataacgtgattcttctatcttcaaaccattcacatgtctgtttttaatctcctgagttagagataggaatttgcccactattgtaagagccaatgagtgaccatccactgggcaccacatgcacttccttgtccgtgatccgcttcgtggaatgggtttcaggaactgttaaagactcactcatggtgactctgctgatgatagcggcaggaaacccagggtgtgagcacatcgccttatttaaatagtcctcattgcacacgcacattatgagacctgcaaaaatataattaaaccgtttttgagtggtaacataaggaactccattggctgctcagtaaaacaactttagcaaaggtgaaatttctaaaagtgtgagtctggaaactatgagatcatatagcaaacaaaaacattttaaaaaaaatataggccatgtgcttagcatgaacagaaataatctgatgcccagaaataaataagccttggtaagaaaagagtatagcatcaactac

SEQ ID NO: 17560 - DNA, 1181 bp, Mus musculus
tgtagatctgcctgcctctgcccactgagtgctgggttaaaggcatgcggacagatacacacacacacacacacacaccaagtcagcttttgtagataatgcagatagatgactgttcttcactgccatttgaatcagatttatttaaactactttcagacttacatacaacttcaacaaaaattatttcctttttttccataaaacttatttttatgtgtgtgtatctgcatgtgtgtggctgcctgtgagagcctaacagtgggtagctggatccggagccacaggtggttttgagttgcttgatgtgactcctggaatcaaacttggatcctctgtaagatcagcgcatgcccttaagtactgaaccatcttcagtctctacaaaactttgatattaaagagaatattaaacattgtgctgtctgactccattttaagattattctttgggaaaaggaagcagtggtgtggtcaagctttggtaaatagttttgtaaagaagctttcattgtttcgactgctcttagactctgcatctttctcttccattgctagtttgacagagagaatgtccgaatcccagggatgctgattattgatactcctggacacgagtctttcaggtaagacagcgtttgccatcagacatgacttaactcagtgagccaaaacactggggggtagtcattaactctgaatagttccttggtatctgcagtatcataattaatcttctgatcatcattggttttataatgtttcctgtgctttcttggtttctataagaagacatgttttataattggaaagagcatcacttctgtgtaagaaaacttcttcatgaattcctgttctaatttctgcagactattacaaagggaatgttgttttcacttcactatattcacacacacacacacacacacacactcttagaggaacttgtggcattagcttatcccagcagcctcaattttcatgtctgttaggtgagtgtccggccacttaagggataatgggagtccttaatacacagctgcatgccctgcacgtccggggtatggcctgaggttcagggacagctgaggaaggtcacgttcatgccagctaagccagactccccttgttgtcaccctcgactgcatgtgtaacacctattcacccagcactcacactca

SEQ ID NO: 17561 - DNA, 1066 bp, Mus musculus
tgttcatttcggggtttttgtttgtttaatgcggggcttgagtgtttagataagcacttacctactgaccagcagtactctgggtgtatttgtggaatttaaaaatagctagacctgggccttctgttaatggtgctctgtgctgctcttgcttctagggtttgaatgctgctttgttttatgagaataaagatccccgcactttcgtgtccttggtacctacctctgcacatactggtgatggcatgggaagtctcatctaccttcttgtggagttaactcaaaccatgttgagcaagaggcttgcacactgtgaagagctgagagcacaagtcatggaggtaatcatcaggcttccttgccacgctacagcccttcagtaatggacatgcactgcttttagagttggtgacatgccttcagagagagagatatctatatatctatatctatatatgtgtgtcttgtttgtttgagaacaggttaaagctctcccaggaatgggcaccacaatagatgtcatattgatcaatggacgtttgaaggaaggggatacaatcattgtccctggagtagaagggcccattgtcactcagattcgaggcctccttttacctcctcctatgaaggaattacgtgtgaaggtaagcaaaggtggcgggtgtggacatgaggacgacacaatgcttatatctacagatgccattctgtctttctgagggctgcttggcataacacacagcacacatttgtccctgtccttgtgttactgcagaagtggacatgggtagtcaagttactaggactgcctaaggatcgacagccttgggtgctgcatggagagtcgtgactgacagtcttcctgtggaagtggagccattcttagtgctgccccttctcaactaaaaagcacttcatatttataatccactctatggctttgttgtgctgtcattctacgggcatggaaagtgcacttctttgtgcaccttctgctaacttgggcctgttttcccagtgtgtgcaggacacatctcagtgttaccccaacaggagttagaatcct

SEQ ID NO: 17562 - DNA, 1141 bp, Mus musculus
ccaaaatgtttgggagacattttgaagctacagatatacttgtcagcaaggtaagtattttactagcaaaagtagcatattttcagactgaaaacttcagaaatcttagtcccttttatctgtctggttgcctattgcagtagttcagagaactaaaatatggctttgggaacatcaggtgttgattctgatagacagcggtagtgcctcctgacaatctcagggactccagagccacagatgtgggcttctccctctgaaagcaggctgcaaagcaccgcctttctgttgcttaagtgagatttggctttctttcatggacacagttgttgtacctttggctcaccctgtttgtgcctgggctattgcagatcagccggcagtccatcgatgcactcaaagactggttcagagacgaaatgcagaagagtgactggcagcttattgtggagctgaagaaagtatttgaaatcatctaattttcccacctgggacagaatttggagtgatgtaatattatgttgtgatattaccaacggaacagacgtttggacgctgatggacttaggtgtataaaatgttttccatgagaaaccaagcaacttacactggtttgacagtggtcagttccccgccccacagtccagcgtgcctgcactcacccacccttcctttaagacttggctgctgttttaaagtttgcccttccttcaaatttggatttttattacaaatctaaatctttcaattttatactgattaaatcagtcctgcagtatttgattaaccaagcttctacagattttgtgattcttgggactttttcgatgtaagaaataagtttatgggtattctttccacagtgacttacccttctcccacccttagcgacttttctaactagaaaatgtaggtagggacttcgctttttccttctgctctgtgtgcagccatggctggctacaattactgcttgtactagtcaggagagctcattggaacaaactgccaataaagaggagacactgcagtcgagtaggttctgctaggcctccattctagctcatcagcacctgctaacgcttgccctcagaggggcgctctgcatacattccattgtttgcttctgcatgattagacc

SEQ ID NO: 17563 - DNA, 1146 bp, Mus musculus
ccagatctaaggaaaagaggcagttctcatgcttgagggagaaaccctaatgcttgtataaataaatacctttttatcttaatacttttaagccgggcagtggtggcgaacgcctttaatcccagcacttgggaggcagaggcaggcagatttctgagttccaggataaccaggggaacacagagaaaccctgtctcaaaaaacaaacaaacaaacaaaaaccttttaagtataggatgataatattttgggggggggggggattctcccatctgaaaaggtattttctgttgtccctttccatgggtgagttcttactgcaaggtgttgtgtgagtcatatgtggactcccttgtatgttactgactcctactctgcactcaccttcagactcgggcttcggtgcccatcaagatagggtagggactagctttttgaaggccgagggtctgaacttttactgttcctgaaacttttatttctgagcatcaagttcacatttggtattttacagattgaccagtctgttttagaagcgctcccacttgatctccgggaacaaatagaacaagtttgtgccgctcagcagggagagccacgtggaaagaagaaagaaccagtaaatggctgcagttcaggggtgttgccacatcctgttggaacagttttattacagatcccagagcctcaagaaccttgtaatagtgacagcaagattagtgtaattgcccttccagcattctcacaagtacgttgatgtcagggaccttcagtcatgcttttctcacctgtcctctcctctatctaattcctgaggagcttgcacttctgcagacagtggttggcacctcagcaccagagggaagagatgtgggaggcaggtgttggtccctaaagattctggaagacactctttgttgactttactggttcacacagatcatgagacctcctgaataggggaagatgcccagaagtgtccatgtgtttttggcttcccattttgtaaccgagtgtcttgttctgattagttagcacagaaattggattgctcatatccagtgtcttggaaggttttgtcctagctttgctgtttaaggacctgttaaagtgatttgaaaacagtctagctgtcctccagaatta

SEQ ID NO: 17564 - DNA, 1160 bp, Mus musculus
ttgatggacttaggtgacactgcaaaagggtcatgtgattcccaaagggctggtgacccacaggttgagataccctgcctctgtagcagtaatgcaagtgaattggtgtttcctgtccctcgaatgcacgtttgcattgggcacctctctgggatttagggccatacactgcacattccgaggatttgagatctggcaagttcttactctttggaactctcatgtaggaatctaacagtgttggaatacatatgttaccagggatactaatatttgcaacaggtcagtgacagcataaaaaagtaaagcaggaaaatggcttacagagtacttagtacactgagaacatgaccacttacagtagcatacagtcaaggtgtatgcacagtgtgtgttttaagtcaatgcatatgatagggaaataagatatgctcaatatgcagagctaagacacttgagaagaacctattaggttaaggaaaagaatcagtgtgcttttcatctttacctttgtgtagcccaaagaagcagaagctttccttctgagtctttcagaagaaattcaaagacgacttgaagctgctggcatgaagggcaaacgcctgactctgaaaatcatggtgcggaagccaggggcccctatagaaactgcaaaatttggaggccatggaatttgtgataacatcgccaggtaaacttattctttaagaaaggaatgttggtagttatattctgtgcagcttattataagtcatacaacataatatcagtagtagtagtttgagttacaacttaccaatcctggtgttgttaagcagcctgtagaggcaggcacagcccatggtcacttgacttaggtttaatacctattgcaaaatactgaatgtcaatggataatttttaaagaaaagatttatttagttcacagttcctggtgatgtaagaggctggtacccttcaactgtctgccagccagtggcatcccagtgtcaggaacatagatgacagacacaaggtgaggcaagaagctaaactgctctgaacggaccagtctcgctcctcctcccttctgtaaacaagtgctcaggacagcaatgacctagtcagttcctgtccttgtctctttaggcccagatcactgacaccagcatgactgtgaa

SEQ ID NO: 17565 - DNA, 1233 bp, Mus musculus
gttgtggttcagagtaaatgtggggaagccatcatggatgtctgtaggcatcagcatctcagcacagttccattctgatctctgtagtgtttgtgtctgtcctgcaggttcagatcataacaaagtctttgtgtgtgtgtgttttaaagatttattattatatgtaagtacactgtcactgtcttcagacacaccagaagagggcgtcagatctcattatggatggttgtgagacaccatgtggttgctgggatttgaactcaggaccttctgaagaacagtcaatgttcttaaccactgagccatctctccagccctcatagtgaattcttaaacaagaatgttaattactgatttgtggataagatcttaatcttgttatttgttatgaatttttttgtataaaatttaagttaatgttttgtgtatatgtaaataaatgaccaaaattttaatagtttgtcatttgtgtacatattccttttcctaggagttggacgttcaatggaatctaagcttgcatctttggggattaagacttgtggagatttgcagtgtttgaccatggcaaaactccagaaagaatttggccccaagacagggcagatgctgtataggttctgccgaggtttggatgatagacctgttagaacagagaaggaacgaaaatctgtttcagccgagatcaactatggaataaggttcacccaggtaatgtgtctttacatggtcctgtttctaacctcggaagctcttggtgattgaaataaacatataaactgttggtttactcagagccttggcaacttttaaggtagatccttaatttaaaaatgcaggtctcaaggaaagatataaaatactctgcttttgtggtcaaaagtgatttgaattacaattattctcattaccagtgaagtgaaaaaggccaaacaagtattttgagtgttaaaaattgtttcatacccaatctgggccagagccctgagcagaccttgggcctgaactctgcagccagtcccacaacacctggaggaagctccactctcaggctctcttaacactcccaggatcatagcagaggtgaggaggacacaacatctgtcccaactccaccgggaataactgggaccagtgggatccagggacttgggaaccccatctgaccaatggcacagattccttcctgtctgggccggaaccctgagcatatcttgggcctgaactctgcag

SEQ ID NO: 17566 - DNA, 1208 bp, Mus musculus
tggtttcgagattattcctcttgtctaccttgtcaaaacaagtagtctgttatcaagggagataacataaggttaggaaaaggaacagcatttccacttgaagatatgggtgtgtttctcctagccagcatttagacccctttgtcctatagagtcacaggggtttaataaataatagatagttaatagtggtattttgcttttagatgaacagctgtcattgaattgatgtgtgtaaacttttgttcattaagttttctgataagtcatgtttgaaattttgttaattgtgatccatttgccactttgaagcttttcatgtgtacagggtgttctgggtccagtcgtttctgctgtagtagttttggtaaaggattagaacactagctttgtatcagagtcagataactaaatggtggcactttggaaaggttaagattagaagatgtgttggtgtgctggtgtgctggtggtggggtggtgtttgcagtatctgacaactcccagagccgcccctaggtgtgactcactcactgccttctctttgtcctgatagctacacacacagcatcgaggctgtcagctgcgatgaagcactgattgacgtcacggacatccttgcagagacgaaactttctcctgaggagtttgcagctgccctccgtattgaaatcaaagacaagaccaaatgtgctgcctctgttggaattggttagtatgtggcttatttttttttccatttgcaaaatgtttattaattcactgcattcataagatgttaacactttaaatgtttatcatttctaagtaaaccagaataaacacttttatcagagatgtagctaataatgattaatactttttaaaggacctaaagttctcccaaattttagtacaggtagttttattgtatgtttcatctagcaggtatttttttaaaagtatgtagaaataattgtttccaactaagtaaatataccatgtaatcaatctgccaaatcaaaagcgctcgccaagctgaataataagttacaaagaaataataattctgggttacacagattatgcagtgttttcaaagttctttaagaattacccactaacataaatctctgacacttaacagttggaaggtaagtttcacagtaatgtaattttaacttccatttacattcattttaatatattactacgatgttaatgtcaca

SEQ ID NO: 17567 - DNA, 1609 bp, Mus musculus
ggttgaatacagtctcactagctctcatgttgactggagttaactagcgacttcagtcccatgtgctgtggtattgggtttaatgtgttacataagaagtacagtaaaactagaagcagggtctgagggaaaacttactgatcattttatgaaaaacaaatagtaaatacaagacaactcctgtgctttggaagttagaggtggtagatagtttttctatagaaagtttcagaataccagtggacatgcctgtgcctgcctataatttcagtaataaatgtcagtagaaggccatttaaagagtaggcaacttagaggcaacttagacgctctttttattattgaaaagaaaagaaagaaaatatcaatgtttccttagtttagacaaggcttatccttggttgaaacaaaaatataatgtctatggcttagcgtatttaagagggaaacagtaagtcacaaagaatttttttaaagctttcaaatcatatacattaacttagattcttcttatactttagaaatcacataattaagaagattgagacagaaagtgaagtgaaagcaaatggactgagcagctggaatgaagacggtgtaaatgatgattttagttttgaggatctggaacatacatttccaggaaggaaacagaatggagtaatgcatcccagagataccgctgtcatttttaatggacacacccatagttcaaatggtgccttaaagacacaggattgcttggtgcctgtgggcaacagtgttgctagcaggctatctttagactccacccaggaggagaagagggcagagaagagcaacgcggacttcagagactgcacagtgcagcacttgcaacacagcaccagaagtgcagatgctttgcggagtccacacagaactaattctctctcaccatctttgcacagtaacactaaaatcaatggtgctcaccactccactgttcaggggccttcaagcacaaaaagcacttctgttctgactcttagtaaagtagcgccttcagtgccatccaaaccctcggactgcaacttcatttcagatttctattctcgttcaagactgcatcacatctcaacatggaagtgtgaattgactgagtttgtcaataccctacagagacaaagtagtggtatctttccgggaagggaaaagttaaaaaaagtgaaaacaggcaggtcttctcttgttgtaactgacacaggtagatactaaaattgttttcttcaaaacagttctatttaattttgttcagatgttttcattagtattctaattattacaaacttcttaatatagaaaaccttcaggaataccaggttatataagttatagtaagtatacctgaaaactttattacttttttaattttagatttaattgtggtaacttaaaatgttaggtcatttcaacactgtcagaactgggattccaagtattccttcctcatggagacttttatacattgttggttttgaactgtataaatataacattttatattccatgcctaatctcctgtgagaatgaagttgattggtaagggtaattgtgaatttctagaagcctgcttcattaaaaattaaac

SEQ ID NO: 17568 - DNA, 1207 bp, Mus musculus
gttagcagtgtgtaagtgagctttgtaaacctaagacagaaggaagtctggacttatcaaaagagaccatcaacatttaagtgtcttaacagttgtatggatgattttgtgacttttaaagttacattgttctgaggaatgtatccttagaaaattgataccaggaaggagttagattttgtcataatacaagctacattgtatgctttccttcttggtcaagaagagatgatttgaaaaacctatgtatttttaattgcattcatttattttgtttgcatatggctatatgtgtcagtatgtatatatagaggccagaggacaatttgtgaaggtgatcctcctaccacataggttgtggtgaccaaacttggattctcatgcttgataataaatgcttcaacccccttttaaaatgtacatttattgatttgtgtatgtgtggaggtcagaggacatctggtaggagtgagacttttctttctactgtttatttcccagctattggactcattgcatcaggcttgactttaaggacctttgcccactaagctatcttactggctcatgaaaaaccttttataggctggtttggtcctgtggctctgtgtatgtgagcttgcatgtgtgtaggccagagggtgttggtgttcaggtgccatccactgtttttttgttgttgtttttgttgttatttatttatttatttattttataaaacagggtttctcactggctttgggatttggacaggtaggctatgctggctggctaaggagagtattaagtctccgtttcaccagcgcagctgtgtaccaccaaaccaggttttgctgctgctgctgttttacttaggttctagtgtttggattgaagttgaccgtctgtttatctatctgtccccatggctttccatgtgagtaggggtggacaaaaaaaagtctgatattagtattgtgtatgattgtacttgagtctagcatgaatatgaaccaggattttgctctctggcttagtctttcttgatcccactgaaagtttaagaggaacttcttgaaggtttattcatacaacaatggttatatactatctaaactctcattcttacatctgagaacactaagactgtaccattttcaccttttaggcacagtctgaattatgtagctgagattttgatttaggttcgttgagtgcaggatcttct

SEQ ID NO: 17569 - DNA, 1196 bp, Mus musculus
tattcctttatatatgtattttatgaacatgtattttaagaatatccacagtagtgggtttatggttttagtcttctaaatggctaaacactgaggactaaatccagacataggaacgccattatctctggatgtttgtcatggagctgttaaaggaggatgggcactctgtcaggtgctcattcgtgtcactggccacacccagcaatagtgtgaggatctagaatatgggtggatcccgttggtttctcataatttctactttctgcagcttggatgtcctgggatcctttctcttctgcactggcttagcatatggtcaatttggcacccactagagtcctttggggagagggatcctcagttgaaaaaatacttccccaagactggctatagtgtctattgtgcattttctttatgagtgatttacatggtttggcccaggccattgcgtgtgtggccatctctaggcagtggtcctgagtacctcaagaaagcaggctagcaaacctggagccagggagtccgcaagcagcacctctccatagcttaggccttcagagttcctgctctgacttccctggatgatggactacaagctgtaagatgaaatactctcccaccctgcaagtgtcttttgctcacagtgttttactgtagcagcagagaccctgaataagataagaagtaaggatcttggccagctttctgacgtgataacaaataaccgagacaacttgtgaacagagaagctgcattttagattaatctgtgcaggtctcagtctgcaattgattggccctgttgactttggtctgtgctgagagaaactgttctcctatggctagggcatgggaacaagagagactaaaggactgggctccctgatcccagttgagaatacacgtgatcaaagaccttccctgccacccttaccttgtgagatttccacctttagtaggtttccatgagccataactatgggtctctggaggtccttgaagacctaagtcagcagtggatgtggtcttggtcctttgagcttgatgtgtactgatccttatgtggccaatatgctaggagcagggtaggcttagcctggcagctgtaatggctgagctgtcaagaagatctgtctttctagaatacagaaggaaacagaagagtctcttctgagttttccccctgttcctctc

SEQ ID NO: 17570 - DNA, 1175 bp, Mus musculus
acatacatattgttgatagttctgtgtgacctgctctttcctctctgggaagaaatattgttagaacattcaatcacctttatcactcacaggggaccatcgaccatcggcttcccagatccagcctctggtgtcccagcaggagattaacaggaaaagggagagagtagggcaagaaccacacatcagagaggcagttttacctcctcatctcagggcaggggtgtggagggagaggtaacccggcttctcgaacgggagctgcagctctttgagacggtcatctaggctgtggtgggacactaggttttaagctatctgtgactctacactggtcataccatctttgatagagaggtgtttctgtctatgatggaaaggttcaggaggcaagccttccagccctgggaagttatctgaactcttgctagaaaagaaattcttccacacagcctgacagggacctgacagtcatcttcctccttgactgcagaagccctaagagtctgtcctcattatctcagtggtgacattttaattgtcactgtattagataagatatctcagcttgtagatggagagctaattgaggataaggcgcagttgggagaacaagccagggacatttcaggtgcactgtcaccatcaactctggggacagtgcctgtgtgctgattggacagaaacatccttgtcattagaagaaacttacctggctcctgaagacctgtagatttctgtggcccactgtcatgctataagtataataacctacttctaaacctggagtgagagaggaacactgactgtttgtgcaaaaaataccctgagttgttggggatgttggtatgaccaagtagccacattgccctgggccagtcctccaggcaccaaagtatactgaccacatgacaacaccttcaaaaaccacggacgagatagcagtgggaatccccagactgtgttcatcctcacataaaggcatgatagtgtagccagagccggagaacagtacaatttagaaacatttattaaatattttgagattttcctttaattatagtgaaacattctttctccaattaaagatttggggaggggggaggtattgttgttgctctgtctcggaatagcatgatttttagtctgacggtatttaaggggtaaaaatattt

SEQ ID NO: 17571 - DNA, 1210 bp, Mus musculus
accatgggactttgaataaaaacacgcatctcatttactatgaacctttgacttcacccttgagaggggataaaagcccttttgagcaagacattccacgcattaagagttcaactctatttagcatttatgacatcatctgaccacttaaaactgtaactcttgtgacagaaatccttgactagagtttgctcatggcagttaatgggttttgaattattctttttctttttgggggggaaaaagtaggaattggtattgttactgtttctgtacggaagtgtctatccagtgtgaacatagcttctccacgactctactggaagttttgtctgtgctgagttagtgttggggaggttttctcctacctgctgacgtgttagcttttataacttaccgagttcagaaccattatgctgctcttcctggttctgtccacctcttttttcccctcagtgttcttacgtaaaagcccccatggcagtgatgctaaggagaacaacacaagtttttgggattcagtgccgaagagaacgtggcatgattgtcacgttctctgttacacattgcactgttgggagcagaccagtagtcactgggtacttttaggggattcttggttattggacaatttcagtagcacaacagttaaaagtaccacgttctctctgaactgtactgggtgtcgatttataaatggcagctaacaatgaataccattgagagagaagtttactgttccagacaaagagaggctcatggcctagattctgtgagaagcagttatgtcaggcggctaggagtgcaggtgattctcaggctccattgtatgggtttcagttttaacagtgatggattgtaacagcagcaggcagcagaagagaccctgactacccaccaagccctttcttgatggcatcatactagatgtgcaaaaccctgttttccagaattacagacaactccagagcgcctgtgctagctgtgtggctgtgtaaaatgcctcccaatccattgttattcctagaacaaactggagcaagctctttggtctgagccaactaagaatttagagtttctttcttcatggctctaactgggttgcagcagctcgttctgagcaagtatgcactctaggaagaaagaaactctgtaagtcagcagaccaggtcagcggagcccatgctgggcttaagcagtaactccccca

SEQ ID NO: 17572 - DNA, 1159 bp, Mus musculus
gtgtcagacccttgaatattgccagatcaggggttggctaggtgagatgtgagcacagaaacggtacttcctctatcgtgtcccatggttccgttcacggatgatgttgggctctgattacctgctcaggtgacagatgctctgatgaccccctccccagcctgtgtcacccccataaaaggttaggaaagactggatatttgcagacagatggacggaccaggaggacgtgttaggagcctgcttccttcagctgtcatgtcatcggcaccgtgccagctagccagtgttagggtagtgtcacccgtgacctgtggattgtacagacccagcactttcaagagagatgggatgctgagtggctgcaaaggttactgggacccatgcagtgtcgaatctaagccagaatgatacctctttctttcaccttgacacagcagtagccatagatacagatcatactctccttgagcttgaggccctgtgacatttggtggtcataatcacaaaacagtttgagaagtctgacctttcaggacccaggctagcccattctttgggacctctgaccctacaagcacctgcttcattcttctcttctggaaagtgagggtgttataggaacatcacctttgaggacttagaacttggcacagggaaagaggaggaaccagccggtcctgggaactcaggctgctgtgaaatcgggtactgttgtctttgacccctgcttttgtcttcgactatcccatcagtgtgagcagcaggggcatttccacctgtctcctgaatgaacctccctgtcctgagaggggagtgaagaaaacaaagcatttccagcggatagagacatgcacttgctgacgtgtcaggacaacacacaggcgtgccatgcctgttttgccgagtccagtgctgtttacagactgccaagtccgttcatgtcgcaagatgggatcctgtggccctgagcctaatagtgccaccatcctcgactgaaagaccacaagttggataatcagattcatcagcaataaaatcctgggtgaggccacctctggtgatgtcatacaggtaacaagtcaccaatcatggcactgaggccagccccagcaagaagaaagccacagccgcagtctcggctgccaaccagcagcaa

SEQ ID NO: 17573 - DNA, 1227 bp, Mus musculus
gccttgacatcctaacaggcctgacacatcctgagactggcctgttgctcattcacctgggtgttttcaaggtcatagaggcttgtttgccagaacacaaggaacagggatagatgtgagaaactgccttgtttctgacggaagcattgaccttagcaacacatttttattaggaacgttccatatcgcatccgagtacgcttgtccagaaaacgtaatgaggatgaggattccccaaacaagctctacacgctggtaacttacgtgcctgttaccacattcaaaagtaagtatcccagcgttccgcaggagttattgtatgtgagatgatgtgtgtcttaactatgttcagtgaagaggtaagcagcaggttaaattatcagatgttccttaaaaactaactggctgggggaagatagtacagaggttgctgggaagggcggcacaggccatgggttgtgcagtggcctccagctggggcaggatgcgtgggtgctgactggctgttactctccttccagatctacagacggtcaacgtggatgagaactaacctgctcgtgtcaaataaagttgcagaactgccttcagggtttggttttcctttctgttgtctgcctcatgggtggaatttttgggtctacagggtgttggaaattaatctgagaatctctgttctgggtacatgggaaattagaaatacgtgaaacattcttttcacagaagtcactttattaggattgtggatttgggttggttttgaaacagggtttcttgtggcactgcttgttctatagaatagggtggccttgaactcagaaatccacctgccttttcctccctagtattggcaattaaatgcccagcttgtttgtaagctctcattttcagttccaggtttatgtgtgagcctaagattaggtaaagattgaggttataacttaaacgtactgaattaacttatgttgtgtgggtcccaggaattggacctgggacatcaactctgcctttccagccatctttgccaaccagtagctcatctctgggatgtgtctgccctcaaaatgacattttaaaaaagtcagtacaaaagaacgatttttattaaaaaccttgaggacaaacattaaaggcatggtttgaacatgtttttgtaagggcatataaagtgaatacgagatatattaaatggtttcaattaccagcattgaaacaaaattagtgcaa

SEQ ID NO: 17574 - DNA, 1163 bp, Mus musculus
agagatttaattaagcacacagacaagctggttaattcactctggcctgggaaaagccagtaacagaaaaaggggtcagcagtgtggttgaaggaggaaattataatttgggaaagcaagggggctagacaaaggcttgctttttaagcttgagaacccaagttcaaatccttagaagtcatgtagaagctgttggtgcacatctgtagtctctgctatgatgagatgggatgtagaagagaacaacccctgaagctgagattggtcagcccagtgcacagaaagctgtaaacagagacacttcccatccccggaccccttccttccttcgaaatggtgaaatgtaagaatgcacactcatttttgttttttgattttttttttttttttttttggtttttgagacagtttcttggttgtcctggaactgcctttgcctcctaagtgctgagattaagggtgtgcaccaccactgcctggccacattcaagtcttgacttcggtgtgtgcctatgcttacataaatatcagaaagtgttggaaagaaaaaactcaaaccacccaccaccacagtcacagcattagatgtgaccaaggaggaatacaatcagatgggagacaaaaatgaggaaatagtactcaaatatcaagaaaagctaagcttaaatggcatggccatgggctagagaaattgccactctcagtgctctcaactccagtcccaagagatttgatgcccctggcctctgtcaagtaccaggccacatgaatggtacacaggcttacatgtgaaccaaaaaaaaaaaaaaaatttttaaaaccatgacagtatgaccactataaccaaaagtgaatgtatgaccaagcaaccaaaacctaagacaactagaatctcttcagttaaattatagaaatgttcttaaatctaaaaaaaaggatataaagaccctaataagtatttaaaattcaaaatagaccagagaagagctcttgttaacagtcaagatgtcaagaagtaaacaaaatctgaagagaaattgattttgtatgttgcagtttctgtaacctgaaaaagccagggaagataatggaattctatgtcctaaaaaaatattaacagaattagtaaaaatgtttctattactgaaacctacacatttcaa

SEQ ID NO: 17575 - DNA, 1234 bp, Mus musculus
ttatttgtttgaacaaggagtaaatgcacaaaatacgcacacacacacaaaaaaatgcatgttactctgacaggtgctggggaatttggaccttaccccacggctccatccaaggtcctgttcttcctgcattgagtccccatggtccttcaggacagaagtgtcacattcaaagataaactttatcaatgaagcctagtgtttactttattctatatgagcaacatactcttatttacaagataaggaaatatcactggagactctatttgaacgctggattccatgttcctcttctgtctcgatgtgtgtacacggctgtagtatttttagctatgcactgggaacaggaaactttgatcattgtctcctgttcgcccgccatactggacttttcccttggaaaaggcagaaatttgacgaagcttctctttcccaccccccacccaatctagccgctgttaacatctgggcacactcttgtctgctgttttcttttctaactaaggcagattgctccaattaaaaaaggctttataaagaaatcgctgttcggctacagaacgacctaaagtaccttctggttacacagatgaacttctttctgaacgctttctagtgcgtcagagaagggtagcgacaaaggtgggaacacataattctgtgaaactggagttacctgacagggctgttttataacaaaagtggtacatttggttagtttccatggaaacaaagaaactaaagaggaacaaaatttgctaaacttcaaatgtttaacactagagattattttttcccaaaaggttcctgtaaggttgaggccagggactctctttatcagtatgaagttagagttgtagttcgtgaaaaacagtttcagttctaacaatgaacttaggggataagcgtgccagcatatttttctcttctgcttccctaattctcattaaaaagaacgattgatattgtatcacaagtcctattcagacctgatattttccataataggatgtttctcatgataatttttgatgtgtgtatgttgatatgggtgtggttctttgtattgtatgtacagaggcgagaggctcacaccagatgcctcccctaccctttcaaggttggtcgtctctcattgaatccaaacctctctctgactaggttagcctggccagcaagcctgagatatttgcccatctctgcctgctggatcccaaaccaggctctgttg

SEQ ID NO: 17576 - DNA, 1198 bp, Mus musculus
caaccaagttagtgcctcccctgccataccagccctgggctggggcccaaaacagggattatgtcccaagcattggaaggggaaagccagcatgagactggtcctcaagccaggctggtcctctgctgatggagggaactggcctcatttatgacctttaacccccttgccaagtcatgtcttttccttcagccactgaccgtacactgaattaacatgaagtgttcccttacagtgagagggtttgcaacaatggtctggggggcggatctgtggtagtgcccctcatgtttggcttcagatggtcccttaagcgtttcaggggtccccaaaatggtttctttgggtatgttcatgtgtgcatgggtatgagtttgtgtccccatatttatgtcttcagtgtgcatgcatgtgagagagatggaaaggagaagatagggagagaagggagggggagggaggtaggggagggagggaaggaggaggggacagtgtatatgtgtatgtatgtgtgtgtatgtgtgtgtgtcttgtgtgtctgtctgtgcctgtgtgtatgtgtatatgtgtgtgtattttttatgtctgtgtgtgtgtgtctgtgtctctgcgtgtgtgtgtgtgtgtgtgtgtatgtgtgtgtgtatgtgtaggtcagagtcaatttggacgttacttctcaggaaccgcccaccttgtgtttgagatagggtttctccctggaacctgggcttcctgtttaggccaggcaggatgtcctggttttatctccccagccctgggattcgaagcgcactttgctttgcatggcctttaccgtgagaattgagggcctcaggtttgtggaacaggaaatttcctgactcgagtcagatttcaagccccaagaaggagcttctaggaacagttttctctcccagcctgcggtgtcagatgaacttgagccgcgttgatgaagtagacacacgttgatgttccatttgtgtccgggttgacgcatggactcttcagggtgcctgtgccgcctgcttgtgaaggagtgcttttgcttctcgctgggagtcggcacaccagtgtcgtgcggctgccccacctgctgccatgccatccagtatcgcgcgcagcagatagcaacctacgtgtaaagatctctgctgtggcaaatcacattttaaatgttgaccaaggctcagagcca

SEQ ID NO: 17577 - DNA, 1194 bp, Mus musculus
gtcttgtttagcattcttcaagcgagtgctactgaatgtgatccatctgaggggttttctttagcaatttacatagtagttagtatacttgctttctttgagttagattttacaggaactctggagttttatttatagtctttataaagcaaagccagagagagattggttgtgttgatgtctgagttttctctttcattcgctctctttttttgtaatttaatttttttttttacttatttactttatatcccgatcactgccaccctcccagtcaccccctcccacattatcccccccccccaacaccctcctcttctgggcaggtagggacccccactgggtatccctcccaccctggcacttcaagtctttgtgaggctaggctctcctctccctctaaggccagacaaggcagcccagctagaagagcatatcccacagacaggcaacagcttttgggatggctccgccacagtttgttgggatccacatgatgaccaagctgcacatctgctacatatgagcaggaaggcctaggtccagctcatgtgtgttcttggttggtggttcagactctggttggtcagggtccaggtgccaaaatcttctaagactccagaccaaagtccccatgggggaaaaaaagtatctatgtatactgtagaaactgagaaggtgtgtgtgttgaggggtgacctggttgccagtggctgatgggctcattcagaggtcattacccaggaactgtttgcaacacacatgccaacatatggtacgcaacccagatgtgtgccttcctgaagatctttactgaggatcagaatcggacaattagaaaccttctcattgtaacttcagagagattactttttaaaaaaaaaaagatttatttatttattatatataagtacactgtagctgtcttcagatactccagaagagggtgtcagatctcattacggatggttgtagccaccgtgtggttgctgggatttgaactcaagaccttcagaagagcagtctgtgctcttaaccgctgagccatctctccagcccgagagattacttttaagtgtggaacattctattaaagtttatattctcaagtaaaaagggaaaggatttaatgtggacccagaaaccctcacctattggtatatttatttaagtagactaaaacttgaaaaaacg

SEQ ID NO: 17578 - DNA, 1333 bp, Mus musculus
gtccctagttctgaagactcaagatcatggcactagaactggcttcatgttggtgactgcctatagtagttagctttctatcatcgtaacaaaaagctatgataatcaagaagagggagttggagatatagatggctggcagttgttaagagaactggctgggttttattcccaatacgtacatggcagctcacaaccatctgtaactccagttgcaggggatccaaacacccttttctggttcccataggccgtgcatgcacatggacatacacacaggtaaaatactcattgtggtggtttgaatacgcttggcccatgagaagaggcgcttttaggaggtgtgaccttattggaggaagtgtgtcactgaacactaccatccctcctccatggctgggaagaaagaacgagaatacgaggaaacgagggtcccacagtctccttcatgacacactcctggtaacttgaatgcttgctgttggccccttcttctcgaatgtacctcccgttcctaaaagtgctgcccacaagactatactttcagggatcatttctatagttcgttactagagaagtttctctgactgtgtagagcacctgaaaccacgaggacgagacgtagcgtcccctcctgagcgtgaagccggctctaggtgctgcatgattgcagctgcctcttgccattgatgatcgttcttctctccttcaggagggtgagagggaaggaacgcagtctgagtgggaaaaaaaaagtgctgcccgctggaaagtgtcccttggaactctgcctttcaaccgctgggctgttctgaagaactcgggtgcaaggtatttaacagcctcaaagacttacagaaaaacttatttttgctatgtgatcattatataagtggtgatccagctcatgtaggagaaaacttcaaaggtgatgatggaggtgggggtgggggtgggggtatcacgtgcttcatctcctaagagaagagatgaggaggggagggaacacaccggagttctgatctgtgggaggcacttgccttctacagaggagacgctctgcctggagagatggggagaagtcctcccaggtgcttctcctttctcacagaaacttcacagacagctcttcattctaggtgtgttgttcaggaaaggatggtcctggagtatgtggctttaatgtgctgagcatttttgagagaggccagagtggattcagaagcgagatctgtcctgtcctcccttgctccccacttaccacaagccatagaaactagaatcctcttcaccagaggccatcataaatgtgggcaagaccatgcacacctgc

SEQ ID NO: 17579 - DNA, 1146 bp, Mus musculus
gagtgaattccaggacacctgaggacataaaggagattttaagaaaacaaccatcatcattatcttgtcgtcatcatcatctgcatctgcatatttgacacctgcatcctcagcctaagtggctatgcttgcattaaaactcagttcatgttcatgttttcctctttctgaaaaacagacttgtattggcatcatgctgatggtgtgtgtgttgggggggggtcacgtgttctcggttgtcatttgagcgtggaactctgatttttatagcattactgtttgaagtatgtcttatcacatgtccttgttaaaggtacccttgtacttcattaaatgcatatagggtgtgtgcaaatgttagctcaccgacagtcatgtgttactctcattataggccactttcgaccagagtttatccgcccaccaccccctctccacatctgtgaggatgaactggcctggctaaatcccacagaacccgagcatgccatccagtgggacagatcgatgtgtgtgaagaatagcactggtgtggagatcaagcggatcatggcgaaagccttcaaaagccccctgtcgtctccccaacagacacaggtatgtatgtatgtatgtatgtatgtttttattacagtgtcctgtctgtgcctatcacagggtgttcttcccaggaagcagtaagtgagcagtcagttgtggatgtgagccagcagaagtagcatcagagggcttcacaatcccagctgctgtgctctgacctttccttgttgacagttttgctctgatgagacaagaggcctaatgatgactagactctattcagtttgtctcggagagaggtaggctaggatgagttggcagcactgttcagttggcagcactgttccaggtacgcatcagtcggccacatcgtctacattgctgcatcaggctggacagcagctctaaagggtgtatggagttattaatgttttctaaaaaatgaggttcagagaatgaatgttgtagactttagctacagtgtctagtggtagaccacagttatctctcctgctaaccaaggttaaaactagatggatcccctgaggaagaagagcaaagatgccaggcggttgtagattttattagatttgcacactttcaagt

SEQ ID NO: 17580 - DNA, 1262 bp, Mus musculus
ttctacttgtgaacagattaaggataaatatatgcaggtgagtaatgtaaatgcttataacattgtcatttgccaagaaaagaagtttctaaaacttgttccttttttcttttccagaatcgtttggtgcgtcttgtgtgtgtgtttctccagtctttgatccgtaacaaaattattaacgtgcaggacttgtttatagaagtgcaggccttctgcattgaatttagtaggatacgggaagctgcaggcctattccggttgctgaagacactggatactggggaaacgccttcagagaccaaaatatcaaaataatacctcactagaacttccctttctattgttcaactgtatttggattggtttttaaacttgtaactcttgagtggattgcttgatctaagaaatataaatgactttatttacttaaagtaaaatttcctttttcctagatgtttcccatggatgaattttggtgagaacttgggagaaatgtttattttagctctcttgctgatgacaatccatatgaatagttattctgaaaatagttattgcaagaaaggtgtaggtgttgctcttttgaatttaaaacacagtacctgtttcttttagaaaacaaactgtaggtttctgaaaaaccaggaatttgctttcgtagcttctagtgtgaagcatggtcagtgagagtgagtgaagacgctgagaatttacggtgagcgtggctcttagtaagcaaggtgtgaaacaaggatgcacatttctgacaacagtgttcctggcccactgacaagcatgggcactctgccaggctgcgagagttggcattttattcttctctcttaaccacagttagtaagggtgtggtttttgtggtcttaaggacaaatacgagctggcacaccagaaatgtatacccaggatgcctgtttggtgaggaggtagaagagtcagtacctgggacagtgtgccttaattttttttttttaagacagggtccatctatgtaattctggcgctcactatgtagagcaggctggccttgaaatcagagatccttctgcctctgcatgctgtgattaaaggtgtataccaccaaatccagcctttttaaaaaatgtctgacataccattttatttaaagaaattatgaagaattccttttatggagatatctctagaaccgatttatggggacagaatctgttctcccacatccggcaaggcttaaaggaagccaagcttggtgattttgtcttact

SEQ ID NO: 17581 - DNA, 1427 bp, Mus musculus
gctcagataacactagaaagcctgtgtgtcatacttactaaatgaaaggatatttctgtatttctcttgctggttgagtttaaaatgggttgtcatttttacatgtaagttttatttaaatgtttctataatttgtttcttgaattattgtctccacatgtgtaactgaggctggacagaccgactgacctaggatggcttttggtgctttgttgtaggagccggcaggagtgagcctcagcatggaggatccatatgctagcaccatcctcactgacagcctcaccgacagagccttggcttgaacaggacattcagttttttactctagggcagagtttgtatacttgaaaacagtggactttattttactttacctttcagattcaggtttgatatacaaagggctgagatattttattcctaaaagacttttaattagccttcatctatttatctactaaattatgatgtctatcataagttttgttgtatcacctgtcacagatgtatgtggaggggttgtttctgagtactagactagcctctgtggtataaaacaagagtctgtctcttgggctttttagacagagctcaccgagttgaagtgtgaagtgtagttccttattgatcacatgaacgtctcctgagcggagactgtagaacttggaaatgagaaatcttgccgtgggcagtggtgcaaactgtggctgaggcccgaggagcttgagttcaagcctgcttcgggctgtgtagccagactgctacaaaggggttaagagagagagagagagagagagagcaagagagagagagggagagcacgcgcgagagcgagagcgagcattcagctggcttgagctgtgtagtctgcagagacttcagaaccacacattccttcttatgtggaattgtgaaaagaacactagatgattttatgatttacatttctacttttattgcctaatttcttttcacacttggaaggagaagggaatttatccatgtttttctacaaactaaaaaaaaaaaaaaaaaaaacctggcaaaaaatgccatattgcatgttaaaaaaagcattaaaatatggattcattaagaaaatcaagtaggcatacagtaatgtctttaaatgattagtatattttggtggatttgatctttacaattaaaaatacttaattaaaagtttgattctgttgttgttagactaaaataacattttcctaaagagattttaagccgattcaatactgtgaccttttatccttcttttctgtttaatgttctcgctggtgaaagtctttgaagactgttgtctaaattctgtatagtgcttagatacatactttgaagagcaaggagtccattgttgttgattctaaacttgtgttgtatgtctactttgtagacaaaaataaatgctt

SEQ ID NO: 17582 - DNA, 1197 bp, Mus musculus
tttttttaaaaagtgtgcacctgagtcctgtgaacattttgttgaacctgaatctgtgtgtgcattctctccaagcccctcagttcctgcaaggacgtactgaacatttctagaggagagaaaggagatttttaaaactacatgtttaaaaaggagccattttgaccctctcagtcagagactacaagcagttaaggagcagtgcagagcctggctgctcggatacctgtagcgggaagctttgccagcattgttgtcgtagcgggcgtcgcctgcagtgctgtgctgactcaagtgctcccatactgctcagtgctctcaggaagcttgagtctcaccttccagtctgcacttctcttcctctgtccacataaaggactttctttaaaagacattacactttaggccttttgggtttaaaaaaaaaaagaaatctgttattaatgtcttctgtgatatatttaggattaacatatgctttgggttattccttccccaataacttttgttgttgttgttttcgggacaggatttatctgtatatcctggctgtcctagaactcaatctgtagaccatgctggcctggatctcatacagatccgcctgcctctgcctcccaggtgctgggagtaaagatgtgcgtacgccaccacacccagcccccagtaacttttacactgtaacataatggaattttaatagttgatgcaaggtactgatttcttactctgcaaatcaccaagtaagtttccagttaataactagtcgtgcagagtatgtgtagaatttttcataagaattaatagaaaatgtccttctagtaatttataaattagatgctggtcttaggctgtgagaaccgatttctaaaaatgtatttgttcttcagttcatttgcaggaaggaatcagtacccattaaaactgctgcacttgctcctcctgttttctcctctccttaggagggagtatcatcccttacgtgtgaggagacagactcatgtgtaactcactgagccaagctcttgggaatataagtaaattgatactattctcttcctatatccaacatttgttcaatatttcctatacaaaacatttgtatgataccaggaacttgttttaaaactgtcaaaagaatgtttaacatttaataatgtttaacgtgtgtctgtgacatacacgtctgggttggga

SEQ ID NO: 17583 - DNA, 1146 bp, Mus musculus
gaaatgttctaaagtttcttttttattaaaaaggattttagcagcccaggtggtggtgtgatgtgccttggagggcagagacaggtgcatttctgtgagttccaggctagtctggtctacagggcagccagtactgttacacagagaaagcctatcttcaaaaacaacaacaaaaaaaggcttttagcttgtaccttgtaattttgggtgtcttatagatgtgtcctagttgttgctatacatgtttctggactgctggatgctcattttcctagagatagttactacttgcttccaggtatgtcttcccagtgacactagggacattaatgcttagggttaggttcaaactggtcccagtatcaccttgcaggcagaggccaccttagaagggtacccttctggcatttcagtaacaaagttcctgtggttaagatcacggtggaaatgctatggactctatgtctcagtaagataacatagtctatcttctgttttcaccagatgaataaataaaaaaagaaaacataatgttcaaggtgtggttaaggaaaaggtttattgtagatgtgagggagagcacagcctgactgaactgggccatgagagaagagagagaggggaaagggagaagaaagagggcagagaaggttgagaaagccaggagaccaacagcaccaagaggaccagaaccacagtggctgggctttataggaaggggagcaaggctcagggctggagaggtctcacaggggcaggcaaatgccagcctgggtgactggaacaggttcttgtgggtagggagagacttgcatatgttaaataggcacctcagttagccatttgttccaaggttctttgagaccaaactattcataggactttctgctctgcaaagtgagcctcctccatccagaagcttctgactcgctgtcttagggctttactgctgtgagcagacaccatgaccaaggcaagtcttataaaaaacaacatttaattggggctggcttacagggtcagaggttcagtccattatcatctaggtgggagcatggcagcatccaggcaggcatggcacaggagaagctgagagttctgtgtcttcatccaaaggctgctagtggaagactgacttccaggcaa

SEQ ID NO: 17584 - DNA, 1208 bp, Mus musculus
gcactgactgctcttccagaggtcctgagttcaattcccaacaaccacgtggtggctcacgaccatctgtaatggggatctgatatcctcttctggtgtttctgaagacagctacagtgtacgtctataaacaaaaaacaaacaaacagaaatcctaaaaagaaaaaaaacaactgtctttatttaaaaaaaaaatagtcatgatatcctgcagtcctgtcttcgcagcaaaagcctctcctatcttagacttactgaaagcaatgctgtcagctcaccctgcagaccactgtatggtgggactgagttgtctgttacacactgtacagtgggactgagttgtctgttacacctgccttcttccttctgtccaaagccgtagccaacaaactcctcacgagtcctttcctgatgctgactctggttactcactggcagttggcctgaaaggcttgtcaccttttctctccctaccttcctctttcctaacttccttttccttcctgtgtcttaggacttgactgcgttggccaaagagcttcgagcagtggaagatgttcggccacctcacaaagtaacagactactcatcctccagtgaggagtctgggaccacagatgaggaggaggaggacgtggaacaggagggggctgatgattctacctcgggaccagaagacaccagagcagcgttagtgcttgctgggctcaagagaagagccttcccactgggccttctctccgctgcagccttctgccctgttcatgaactcaatgacatacagcttttatacacacacacacacacacacacacacacacactatacatgcctcctgtacacaccacatatatacagacacacactacatgtgccccatttatataccacacactcaacaccataccatatacacacactacacacacaccctgtacacaccacacaaccaaatacgacacatgccctgtacacaccacatgcttaacaccacaccacataaacaaccacacagacacacacattataccacaccacacacacacacacacacactacatcatacacatatacacacatacaaacacacatatcagcgtcttccccacaatatctcagcatgtctctttttcttttaatttaagggttcagtaaaagggatgtttcagtgtggtatgacttaattagacataagaactcattctaat

SEQ ID NO: 17585 - DNA, 2963 bp, Mus musculus
aatcagagaaggaaatgctgcttgctcttgagtggctgggttccaggccccacaggcccctgagtagccttctgctttgtggtcaggagctgaggctgatgcctgacattgcatggctgtgcttatgtccccagtgtgtctgctcgccattcgtcctcccttctctcatggctgtttgtagaagtggcatgaaagaccccagggaagttgacttgttctggtactgactcatgactacacagtgacagaacaggcagacagcacacggccctcttttggtcacttgagtaaagtgaacccagggcctcttgcatgttaagtaggctttcagagatatgcctagcactgaggcagaactcctggcaaaccaagtcgtcatgggctaggactcagcatccgtgcatgggaatctgaagtggcttgtcaagactcctcctcgttaatgctttctctctctctctctctctctctctctctctctctctctctctctcaaagcatatatccggtcgaatcagacaatgggctggggagagaaggcaatagagatacgatctgtggaaactggtcacttggatggtgtatttatgcacaaaagggctcagagactaaagttcctgtgtgaacgcaatgacaaggtaaggctcccttacggcgtctgggcacttgtggctgctgtgtacagtggcttgtggtccactggcagtgatgatgcattctaaaataaaccaaggagacactttgtttgggcctatctgggtttgggcaccaggagatagtgaatggctgctgactgtgtcctctcattgtgttgcaggtgttctttgcctccgtccgctctggtggcagcagccaggtctatttcatgaccttaggcaggacttctcttctgagctggtagaggcagtgtgagctgggatcactgacctctggagtcggcaagaccctgagcgagaccttggaattccttgcaactggagctcagagctgtgctggtgcagccaggacagctgtctgcaggccacctgcgcgtcgcatcgggtcgggtcgggccctctcccctccctcctacactttttgccagtttattcccattctctccttttcctttctcaaataaatcaaggctgcattgcagctggtgctgtctggactccaccatcggtgctaggagtgcttgggaatggactcagaccgggaagagcgagtgagcgagcgagcgctgcgccttccctgcagctccaggaggccgtctccgagcgagcgagcgagcgagcgactgtcctatgggtgtctgaagggtgtgatgagcgcaccgtcagactttggcagtgggcacaaagaagtgaaaagtgggcgtaagaagcagcttgcagaagcagagaacagatttaatatagtaacattaacaatgtatttaattgacatttctctttttgtaatgtgacagtatgtggacagagaagaaggtgcaggtttaagaagttaatatttataaaatgtgaaagacacagttactaggataccttttttttgtgggtggggcttagggtggggtggggtgggttaaagggtcccattttgtttctttgaaagttttttggaggggattgtcctggccaagaactcagtcatttttctgtgtaccaagttttgcctaaattgtgcaggtggttcttaaaaaagaaagaaaaggaaaagaaaagtgtgtgtcttgttggagggccagaagtttgtcgtgtgacagtattagcccggcctcggctacaggtttaaagtctgttaggcctaagtgcagctccccgtggcctgcacacaccgtaggagaaggtcagctttcctgtggggttttgtttcattttgttttgttttttgcctacctcactgtttttaatgcattgagaggtgacttagtttatggttttggcagaaaacattaatgtttaatttaaccttaataccaaaactatctgattaaagtttgactttgtcacaagtctaaatcaggtacaaaaaaggaaaaaaacaaaaaataaaaaacaagcctgtctatgacagcagggagtagccttgtagctgctgcagtctgcttctagcatgcagactgctctgttctcaccaagttcaccattagcgggtgacaggcagccagctgccacctgtgacacataagagatgtcattgttctcagttgggtttggaagcaggcaggggtcacactggggagtcacacagactgttgatgttgcaggagcctttcttgggagtgacggtgtgtcccttttctaagaatgcaatgcactaaaactgttttaagaatgtagtttgccctacttcttcatagatggcccctccctgcctgtgtttcaggtgtaaaatcgacactctggcttttctccttttctcacgtgctctcttgttctctttttttaaaactaatttttctttatgaatatgtctgtgacatttgtaataaatgtcttgtaataatttgcttcatggcttcatggtcatcactacattctctgaggatgctagtgtctcagtgaagaggcagcgctgagccacaccctgccatcttgctctgaatgggaaagccttgtgacagcttctgtgtgcttcattccccaaacacaagctcggggtttcaggggctggatcttcctttgtggttaattccttttacagcatgcttcatcaatccctgtcccatgtaacagtcatccgtacctactgccaagcctgtaccatcggcctcagttcacacagctgtcagtcattcacttctgtttaatgaacaacaaaaatctagtgaaaaacacaatatactactgcagttaaatggttggttgttaataccaacaaagataggtcaggataagcgagcgacccttattccgtttaggggaaaaggaagcaaaaggctgtatgacttcagagtaatgcaaaaactgtttctcttc

SEQ ID NO: 17586 - DNA, 1112 bp, Mus musculus
ttcccagtgtacagttgtcagattatctttcccagtccttctgatacattggctctcttgctgggctgcacgaagccatgcattaatgtaattgttgtaagaagctgcacacacctcaggaggtctgttctagtaccagtcagtcttagaattttactgctgtgaacagacactacaaccaaggcaactcttataaggacaacatttaattagggctggcttataggttcagaggttcactgcattatcatcaagacaggagcaaggcaacatcctggcaagcgtggtgtaggaggatctgagagttctacattttcatctgaaggctgctaggagaagactggcttccaggcagctaggatgatggtcttaaagtccacacccacaatgacacacctactccaacaaggccacacctcctaagagtgtcatttcctgggacaagcatatacaaaccaccacacagtcctagtcacttattgacagacaacctagactccagcagagtttccttttttctgcccactgttgaacttactcgagcataagaaacaccaagcttcctttttcaaattcctgaagagctcttggagggattctgatctggtgagaagcttagcatgcttgtaaacacagagtgagaggagacaggaatggtggaaaaactgtaagtcattgttgaaaagggttgggatggagaaaagaaaatattaaaacatcaatcccccccccatgcatagattgaaaaaacactaataccaggcatgggtgcttttaatggacagagttaagcaatccattcatccagtcaaccagtatgtaatatgcgttcaggttttatttaatataataccgataaaaaaatggataaaaagacccaaattctaccctcatgggtgttatgttctaatggggagagagtgaggtaggtcaaattaattggttacctgtactaataaatattacgtgaattcagtaacatagggctatgtctgcacacacacatgttcggacatatgtgtaacctttagcaaaagtcttcggcaacaagccagggggatttcttcagaagtagtgatttagattctaacaatgtaagaggaacaagaaag

SEQ ID NO: 17587 - DNA, 1216 bp, Mus musculus
gcatcattggctccatttccttcactataaggttatactagttgctagagtagctgttttgcaggaaacttgaacttacaaccaaacccagttttcactgggtaagctgagctggtctcacgccagtttcttcaggaaactgctgaagaataattgaaataaggattatacatgaggtatgtgtacttgtgaagcactgagggatattagaaagttactgatcatagaactctaagaaggggcaagggggtcagtttttaagtagcccaggtatggatgattcccaggaccactgagggcccgattcctctcccttagagctttttaatctctgagataaaattattcttgtctcaccctgttgtaaagattgcacctaaaatatgtcaaatgcttctccagttgcttccacctggacatttgtaccctgttgattgacatcaagggagagaagtagcaagaaggtggtgtctgaagcagccagtttcatgtctggaaatgtggtcccaagtacttgctccactacttgtctttgtggctttttggactcagcactcaagctgacactttagactcttcatctgcagaaaattgtgacaggtaagatctgtctgtttttactccctctatccatgtagtactcaaagcataccctgacctaaaataaatgcattaggtgactctgaggaggaaaaaaaaactgtagttttggacacacacacacacggacacacacacatggacacacacaaaaaccaagactgagagtgaaagaactgtaatgagttctatggatgtaaagatggatataaactaaagtggatatatgaatatccatcctactcccaagggaaaggggactttgctgacaatgcctgcctacttcttcctggacagagcctctactgagtggagctctggggaaattttagactcatacttcaaatatgtctaggtagaagggctgcttcgagagagttcacccacaccatataataacaccaaaactcccaacctgggagccaggaacccaaagactgaaaactagctaccagagtggaaaatgcctacctcaggccatgaggacctgatgccactggcatcttattgagagcattgtcagtataacacaataggcgcttcaaacagaaagaagattttattcattaatattctgatttggcaactctagtgaacagagacatgggggaactga

SEQ ID NO: 17588 - DNA, 1178 bp, Mus musculus
ttagcccagcccaacatcttctccatctactgctggagtgtgtgactggaccagttctgcagatccaaaggtgcaggatctccatgacacagggcaacatatttgagaggaatatttgagaggagtcccagtaaggcttttgtattgaccgagtagcagaagccagaggccttgaaccaatgcaatgaacactaaagatgtcttgacagaagggtatactgtgtgatacactgtcaccattacagcttccatgatgaaattttgttctgttttgtttttattttatttattttacttttggtagggaggttgcaagggcgatgtgaagggacagggagagtggggttgggatgcatgatgggaaactcacaaagaatcaataaagaattaaaagaaggagaggaagtaaagaaggaaggaggaggaggaaaggggaagggtgtgctattacccaggcaataaatgatatttttgactaaggaatttgatgggctaaggtctagatgtattttgatggtagaaccaatagaatttgttgacttttaaggaaaaaaaagaagagtcaagtaagatcttagcctttctgactagtgtggaaatgaagagtgttacttaggcacagtcatctaattcttaaaatattcctaaatttcagaaaactaatcaaattactttaaaaggaaagtttcatttgactagtaaatgttgcctacgttgtgaggatgacattctaagattcatgagtgttggttgtcgtagtggtggtactggtaagttacgtgaaccttctcttcataggcactgctgtagagaatggatgagagccataagacaaggtttggagggctggggaagagggaagatgtaagtttaatttgacagtggctttaatctcttgtgagtctctcagctgaggtgactggaaacttgaatgtagttgaatataattgtgctcttagtcttctggaaaagaagtacaaatggctcgccattgaccaggaatggctacatcttagtgctgaccttcagacgtctctgaactatgctatgtgtactctcatttcatttgcttgttgaggttcttcagttcaagcagtgctattagcacacttcagcacttaccccagtaatgagcaaaccactcagtgctcctcatactttctttcaaagctaaactt

SEQ ID NO: 17589 - DNA, 1333 bp, Mus musculus
atggaggtcctgaatactgtgggactttcttgaggtttaaaataggtttggaaaaacaagtctttcccttctctccttccctctattccttcttcccttccttacaatgtcttgactttcatgtcccaattagggaagaatttctttttaaaatagagctttgtacacatcctctaaaaattcttttcctaagcagaagcataaagcagttcacagtattgtggtaaatattgccacctgcatcttgaagggttcgccaagaaaagtgtgttgatggtgttgatggaaaagctttctgctctttagttacgtgtgccattttgtcccatggaaagcaaaagggaagtcagggcttgccattcctccttctcagtggcgtaagctgctgtgtctttagaatgttcctggcttacagggaccctgcctactcttttcttatgtggcttgtatgagctttatctttttaaaatgagactgatttcaaagtcttcaggctgggtgatcatgttaaaggcagtactctgtgtcggaaagtttgggaatgatggtcctagaattctagacataagaaaatccagaacgtgtgacagtcgtggtggggtgcttatcagtatgctgtggagtaggcagttgtcattatcaggacgctggagttggaattcactgtagaatgcagtaggaagtggactctgttgaagaggttcatgtgcttcctgcagggcttcctgcagggctgtcccatgcagggctaagtgatgctctttttatttttgtgcaagtagcattatccacttgtataatgcaagaatgtgagaaaatactgtttgctttacattcgtgacgtctagcgtctgctccttccttttgtttcttactaagaaacattttaagcaaaagatacttcatagatttttccatatataatcttcacattgttggtttgcctcgttagtatgccttagtgtcatctcctttctttggtttgttaaaaccaccattttagctcacttatcagaacagccttacagagataattcacccttgcaggccagcgctgtgcttagacaccaaccctgtaggtttctgctttttttttccagactaaatttgtacacataagacaaaatttatgatattaaatattgcatgaattgttgatgctacagtaaggttttaaatacattgttacctacggggttgataagttaatattgttgaactgtgctcctatatgtaatcgtcaaggtacattttaaaagtgcagcttttagagtacaacaacacattgtattttatattcagttgacctctctgcttccactggcgtttctct

SEQ ID NO: 17590 - DNA, 1567 bp, Mus musculus
aggagagagttagccatttgacggttttaagtcagtgggaacttatttttagttacttggtgaaattaaattttaatttgtatatttaacgtacagagtaggttggtaataacagctgaactgtgtaacattgttgcttcaaattgaagtttatactatgaacactcagcatctacgctcacatagcagcatattgttgagctgtcttgagtttgagaagtgaagacgcattgacccatgcactgtgtattacgtagtgcctccgtcacggagcgccatgcctcctgaagggatcatggaattggcttcctccatgcgatgaagcatcgtctgctgggcatctggagcagcagcattgggagggttgttctgaagtagtgtttcagtttgggctagaaggacttgatgagagtggtgaacaagtctggagtaagtttccttaatagtgtatagggttagtattgttgcttttgattctgtattccagtgaggcaagatattcttattcctgggttgggcaaatagatggcattagaggcagtgggaagctcttgagttacaaaaggcaccacatccaccatctgcaagtcagcctcctttttttcctactttgtatctcctggtctctttcccgttctccttcctcttaggtctaagcttcagacttaggtttgcagattgtattgtgtctgtgaccttactccattcactaaggggtgaagatagtctgaccccaatcctcttcatctgagggggtgttagctcactgtgtggatcctacagtctggaatcctgcagcaccagggcactgaattgcttcccaaaggctgtcacagcagcatagctttccagggtagccttattagtgtaggcagctgccagacccttggaagagtggctcactactgccataaggctgtatttgctggtattaaaattcttcagaattgaaattttcatttgaaattctgttttggttgacttaagtttgagagacagttcaaaaactgatgtagagactcattcaacagcaatgactttttaaaaacttacattaagtaaaactgccagtagattaaatcctccccatacgtaagagctttctctactcactactgtggaatccgagcattgttgagaggctactaatcggtcaacatgtttttaagtgtgcttttattaaatgcttgtgtacgttttgtaattcagtgtagaaaaggttgaccttgtaatgtacattttttgtatgtatagccttttaagtagccttgtccttatttaaataaactgaataaaactatcttgagcaggcctgtcatttgcaatacaaataaaatgaaaagtttttcctataacttatgtgactgaagaaactggttcaggaagtgccattatgtgtggcataatcttaaccacattcaagcagcccagttgggttcccctttgtgagcaagagggcagttagtgatgtcgtgtttaggttgtcttgattgatgtgaagatgtgcatccccaagtgttcctaagtaataaatgggacaaagcaggaactgaattgagagaccctt

SEQ ID NO: 17591 - DNA, 1145 bp, Mus musculus
acattcaagaacagaatgctccccaaggcctcctcctaacagaccccactgagatatggaaatcaccatctatgacgacagaggtggaaggtaaaccacagaattacaggtcccgcatccagctgggaccttcgtctatcacctggccaatggcagagtgtccctacctcctctccagagcattattctcttgtctctgctgccagagccacgatggcacacctggagtgaccgctcgtcactcagcatccactttgtctcccaattgtgtaggactctatgatcttttgatttgtttccaagaaaataaaggaagtagttctctttttaaaattcaaagccatttaaaacacaggctgttggtcagcccaagccagagtcgttttcttaccagacaccagtgtcactggttctccttgtcccttgggtcagtttcctagccggctttatgatcccacaagtcatatcttagctcagttcctcccccagattagtagcaggctttgaggctgtgtgtgcctgtggtccggctgatccaccacccaagtccccaagctaccagccttgaccttcttcagatcttcagattgatttctgctgttcaatttcagaggctccttgagagaataatatatgttacttgttttatttagtattgtagttattattaaggcagtatttaatgcaattccggttgtttctttgaaagcatttctgttaacatgcattacctcgagatgttggggagatgttgtgcgtgttgcttgttcattccacagataagtaagcacaatgagcagaccctcagccatcagctccgcctgccccagctctgcccggtgtggaagaagcaagtgtcctaagcacctaactctagttttgttacaagtataacttaggagaaaaaattggtagaaataatacagtatgttgctaatttgtaacctacttctaaactctgactcatagcctcctcacatacagtattcagggcacagaaatcttttgattgactcaagtaagttttggcttccatgtaacttgcaagttaaagttaatttttccagctcttctttatctctgtactctcttagtatcagaatttcttatgttctttcttttaggaatttgagagcactgtgttt

SEQ ID NO: 17592 - DNA, 1107 bp, Mus musculus
tgaggctgagcaatgtatgtatctttttgttgcctataggctattcagtgccttttcttcttggagggtgggtagaaggaatcttctgttgtgaatcggatgttttgtagatgaagaaattatccaaactggccgtatgctcccaactgtgaatggctttctggagagagatctgtggtatggggatgtttcttgaaacctgcactccactgcggtttgtctcctgcctgtaagcatctgccttaggtgggggatattttggcttttcattataatttgaactgtattaaattatatcattctaaacttgattaataggtttatctcaattgggatgtctaaagtcttgattcctatgggaagtagagattctttgttactgatttggctagttacacaattgcatgtatcttctcttaacactgttttgtgtttttgtgaaagaggttgccacagtgtttcttacagggctttggcgcttttatagttagtgtgatgtagtccttgattggtagaacgtttcctttaggaagcatgaataaatgatttaagtggcagatccagggccctgctagtgtatcagatcctgcacagaggttgaggctgaaagtgggtggatgtagaggtgacagatcatgttattcttcagacctctcttgtgtggtggactactgttgggattgtattttgaataagcagtgttcacttagtgagtatttattgacaccaactgtgtgccagggctgtgggagccagccagagatctacccccagggagcctgtaaactagcctagagatttcttttagtccacactcatttctgacctttaatcaccatctccacatttgcgtgagaggtgacactacacaaagtctctcccaccctccctaacaccaacagaaatgtagttccagtattttggagaaggataactctttcccaagttccttggaggtggaggctagaatggtcacctgagagttgttccctggtgtagctgtgtacgttggtggctgcctcaacatactcatccactcatgtagatatttcaaggactcagatgaaagtcagaccatttgtttgcacacagtagactcttgttttg

SEQ ID NO: 17593 - DNA, 1181 bp, Mus musculus
aagccagcctttccatcattttctttttttgatggctaaccttcagtatccagtcctcttcagggtttgcttttgtcttttctggatgtggctttggcctgctgaacgcagaactcctgagctttgtgagtgcttaaggggcagctgctcctcctatctttgattgcagctaactgaatagttaacaccaatagactaatgccagggaggggtaacaaaataccacatcctgttagttaaaagctgtcacggcttcactccctggcagaaaggggctagagaactttacaatagcatgcaggagctgatacacaggtgtggactccttctacagttgggcattgtgctgtcggtcgctctgaagcccagcagaaagctcccacagcagaaaacccaggtccccacctgacctcatgtggcttttcagagaatgatcagcaagggcttcacttatttaatctttgcctcacccataaaagagaagtgagtacctcatttttcagaagaatattgagtcttggaagttactgttgtgctgaagaacacacacacagtaagtcatgaggttgaaattcaaacccactgaagcctgcctgcactctctgccgttctccagtctcttaggggaccccagggagaaaggagtgagctgtctagttgattcctgtggactgttcatattggtgacttggttgctccctggctgttgtttcgatttaccctttgtatgcatttcagttaagttgcttggatggctccttgctgctctcaatggagttggtgcaaagcacatgggctgtctctgcagggtgcctgatattcgccagggcatttaagttttctgacaggccctttacttcttggttctttggagtgcttgaggtttttatcctgttaagggagatattgatttgtggcagtgcatttgctgtagaagtcctgggcttttctgtactgactgaagtctgcttgccatcttgccttagaacatgattcctagccaagtcactctgtggaactacttcattaaagatcaggacacagcccaacacacccctggaaaattttaacattaaagaagcaggacctcaattctgtctcagatgtccagacttctctagaagtctgtcatgacttcacccactctgtggtgtcattactatctacccttgtgcacgtat

SEQ ID NO: 17594 - DNA, 1166 bp, Mus musculus
tttgatagtgtaggagtgggcatggtgtacaacgtatgtccagtgccagctgaatcatttgccatgtcttcacaggcctcggaaagacgcgcaggaagccaagcgctcgggatgcttccccaacgccaagcactgatgcggagtacccagccaatggcagcggtgctgaccgcatctatgacctcaacatcccagcctttgtcaagttcgcctacgtagcagaacgagaggatgagctgtccctggtgaagggctcccgtgtcacagttatggagaaatgcagtgatggctggtggcgtggcagcttcaacgggcagatcggctggttcccctccaactacgttttggaggaagcggacgaagctgcggctgaggcccccagcttcctgagcctacgtcggggcactgcactgagcaatgggcagggtgcacgggtgctgcacgtggtgcagacgctgtaccccttcagctcggtcactgaggaggagcttagtttcgagaagggggagaccatggaggtgattgagaagccggagaatgaccctgaatggtggaaatgcaaaaatgcccgaggccaagtgggcctggtccccaaaaactacgtggttgttctcagtgatgggcctgctctgcaccccgctcacaccccccagatcagctacaccgggccttcagccagcgggcgctttgctggtcgggagtggtactatggcaacgtgacacggcaccaggccgagtgtgcgctcaatgagcggggcgtcgagggcgacttcctcattagggacagcgagtcctcggtaagtgcccagcagctcctgtgctggagccacattgccagaaggaagctaaatgcgcagttccctgacctgtgaggtcagggattccagccagccctggtctgcggatattcaataatgttacaggtcatttgcctcattctccattgttaaatgtctcaccaagtcatgtaagttaggcttaatcctgggcataacaaaaagccttatttctagggttctgatctaccatggttctaggtgtccactggagttctcggaaccgtcctcagaaagaaccacattgtggaagggccgtgactggtaaccgttcccatggcatgttcactgactatacttgaaatagcaaaatggtatttgagggcacgt

SEQ ID NO: 17595 - DNA, 1279 bp, Mus musculus
tgctgaatccatgttgacctctgtgagtgaaatgtagaactgtaggaatgtggaaaatagagaacgacctacaacaacttgggaatcacagtgtgtctgtgagttgagtcgtccaagccaacagtgtctggacagtggtggtaaaacatgatcattaacctggaggtggcctctcagttacctcagcagtgtgtctcgctcccacacaaatcacatactcagctccatcatttccttcagcttggcttttgcctgtccagagctcagtacaaatgtggagggcacaccacacccctaccttctgcagcacagcatacacaccatcttgggaaacataaatctttccaatgccactctgcctatcttctgaaaagtcttggctgacctgcaggcttgttcttccatcctcctgtacacccctttcaatgagagttagcccaaggttatattaggaacatttaacaatgtctaccttgcttggcattgaagcctaaaaaccattactcctcttagggggtaagttgattatgtacagtggagcctaacggagctataggttgcccagttcatcctgcgttgtgttcatgtgtggggctgtgctgtactgctgtctggagtgggtcagatccctggcctctggagtactgttgctgctgctgctaaagggtctggatgctcgctctcaggcctgccagcgcggtaaagggagaggaggccattccctgtccgctaaagcagctctgcagactaagaaaaaaatgtcagattgacagttcaaccttaagagtgttcagaagtgttctcattcaaatcccttagatctgtagctcctttttgcaaaaagacttatatagagttcttgcaaaatggttagtacagggtagaaatgcttttcacccaaaatatgtatgtaaaagtataatggaaagagaaacttaaagcccaggatcagatatgcctttatcacttgactccctgaaatgcccacgtggctaatgtgtgaactgtactaagagggaacttctgaggctggctttttcgatatttgggttttgcctggtttgcattttttttttttttttttttactttactgtggctgcagtagacacgagtgtgtgtcttacatatggagactttcatttacttctcagagaaaggatttgtaagtttggcttgcctactggcaatcccacaagcatgctatgtaaagttagtcttgatatgaaactatacacatggacttggaatgtgtgtcttcaataaaacacgtgtacagc

SEQ ID NO: 17596 - DNA, 2374 bp, Mus musculus
gccagagtgaagaagggccggacgcgccacagctgagttagttagccttaggttatgagactctgttttacccgtatgaggtggacttttgtgggatttttttttttattttttaaagacttcaacaggtgtcatgaagaacaaactggaattttattctgaagcttgctttaaagacactgatgtgcctaaacgctcccttgaaagctgcagactttgccttgcacttttaaatctgtctttgttatgtacaacagcctagatgcatctctgctattttcaggtttttatcttctgttagagtgtatgctgtaactgtcattgacagttttatttactggtttctttgtgaagctgaaaagaaacattaaatggggtggaaaatgtcaattttatttataaaagtgggtacttataaatgagatgttacactatgcataaagaataaaaatcctagaggtactgtcgggtgggtggggcaccagtgtttgttggggacagatgaaaggactcagttgggaagctttgtctttctcttttaattcagagttttctgaaggtctagttttcagttgcaaacttgactttgaaacatccctgttggttcttgatcaaagatatttgaaatcactactgtgttgtgctgcatattggggtgggggtggggggacaacgttaacatattcttggttaaccatggttaaatatgctattttaataaaatattgaaactcatcagacatgggttttgagctacaaagattgacatctgctttacatcagatgtgtggtggctgagaagaacacttgagatcttagtttaagggaattctgagaacatccaggtttataccatatttaacttgatatgtaactgttagaaccatctgtgtgctctctgggctgaatctgtgcatatgatacacacatgtgtatatgtctttatctgaaatacttaaaaccaactgtttcaaatttcaggattgattttgtttaactcgggaatattttcctgaactatgcaatttgagcatcctcaatcccaaagatgaagtgttctgaagtctcaaatcccagtgtctcttcagcactggggatttggagcttggagcccaaattaactgtggtgtgaagttttcagaactcagcctgggttaagttttgtgtcctgtagcagcacaaaccaggtggaacaaaaacttccatttttctggtgtagaattcaaacaagttttgctgagtcaaacgaaaactttaggagtttttattttcattaagaactttctcaaggtgtgtgctaggattttattttgtaccttaaaataaatgggaggaaaacacaatgcacaaaatgcagtctatctccaaccagattagccttacatggtaacagcagaaacccttacaaatgcccaaggaataaaggtgtggaccaggtgatagaagtaactagaaacaggagcacatgtaatatctgagcttggtctatttttcaaaaccatgttgggctgctttttaaaaaaaaaatagggtgtgtgtgtgtgtatttatatttattttatgaaaggctctagaattcaggcaaagatgctctgactctgtcatgctaaatttaccagaagattctgaaactgaaccaaagattgaacatgatataagaaaaaagaatcaagaataacctacacaaacatacacactagctaagcacttacttggtcactaactacacccccagcctctttctcttaggccccgttattttggtctgaactgagtgacacatcatttacagaaaaaaaaaaaaaaaagcagaagcttgcttggaaattagtaatgctaaatttggaccaaagaaaaatgtggacagaaatagctcagagctttacgtataattaggagtatcgaaaagtctgaagacccagaattcccttagcttattgcacactaatatctggaattctttcataagattcactcttctggtatccatagagtattttcaaagtagtagaagagaaacagatgtgtataacgtcctctaagaaagtgagtaatgcattgtagaaaacactgagttttgaattaagtatgatagtatcttaggcagagagggaaatgaagctgagaggtaggtaggtgatggcggctgtggtccagcaggatctacatgtaggtacctactctttggtgcaatagtgttacgaaagatgaggtatctgtacaaactgatgaaggcagagggggaccctttctgtagttcctggctcttgcttgctccttctattgattgctactctgagaaagcaccatctgtgaaccagaacgtggcccttccacactccaaaatctgtcagcactttgatcttagactttg

SEQ ID NO: 17597 - DNA, 1104 bp, Mus musculus
cttagaagttatttgttcaagaaagtacttatagtaggggttgttttctttaattgagttcaacaaatggttttaacttttaaatagaaaaacagaaagtaaccacctatacagttttgctttcatctttttctcagtgaccccgaccatgaagaaatatttagaccctaatctgattaatttaaatgactggctttgttttaattttgtccttggtattcatgagttactggttaatagatttagagaatgacaattaaaaaatagatttaggagtgattttttaaaaaatcttttaaaacaagcagacttagttttaaatgcgttagtttatttattctaagacagtaaatcacatttctagtgagccttgcagatttagatctacataattattcttagttgctaatttttggatagcggtaaacacttaaactttaaataaaccatagaaactgttgtcactagtgctcaaaaggtagaaattgtagccgcctgcggccacgtgaactaggttccccagaaaggcgggctggagctgaaagagatcagacagcaaaaagaacggggccaagacaaaccttgctgttcaaagcctctgaagtttactgagagagtctgtgcttataaagagggtaggtaggcccatcccgccagcccattcttggtgcctggagccagcccattcttggtgcctggagccagcccataggcgatctccagggagtgtctcaggaccgtcccaaggatctttcagcaggaagcagagtcttggagaagagcaaataagagccatcaagatcagaaggctttaccctaggtaatctccttcttagtggcagcaaggtcaaagtctggatcagcctgcttcaaggctgagggaggctacaagaaattatgtgtaatatatcattccttactaaataagataaatcaattaaggctgataattttgctttttacccacatgcagtctgatattcagtgtgtttcattgcttcatttgctctgcacattctccaggaagttggcatctaaaccaccttctgagtctacattggggtgtgtctgctgatgattggttaagtatagatagcttgtgga

SEQ ID NO: 17598 - DNA, 1154 bp, Mus musculus
tacttcacttattttctggttttgtgtttccatgatttgggaagagaagatgatctctttaccccatgaatatgccacccacctcataaatattcatagaaatgtctaaagcgtatatgttagccctacagtgctgctaactcactttttaatgttttttatttttaatcattttattcatttacattttaaatgatatctcctttcccagttaactctccacaactcccccatcccacccccacccccacccccaccacctttgcctctgtgagggagctcctccacccactcacccactcctgcctcactgctctagcatcctcctacactgggacatcaaacatcccaaagaaccaacggcctcccctcccattgattccagataaggccatcctctggtatatatgtgtctggagccatcggtccctccatgtatactctttgggggtttagtctctgggagctcggagtggtctggttagttggtattgttctttctacggggttgcaatccccttcagctccttcagtccctcccctagctcttccattggggtcaccaggcttgtctgatggttgcctgtgagtatctgcatctgtattggtcctgtgctggcagagcctctcagggaacggccataccaggctcctgtcagcaagtgcttcttagcatcagtgatagtgtcatggtttgccgcctcacttttgagtcaccccagtctccccacttctttggagtgcttccttgctttgctgtatcagctttctttaaactgtgtcttgcaactggtatatttgcttccaaaaacattagagagaccacatacatgccccctgcccccaataaatggtcattaggtttggattatggaatagttttcccttgtacaaagaaggaaatcattgtatcctcccttcccacactagtgaagtttagaacaatacccacatttatctaattttaaatctcatatcctttgaactaaattttttggtttctatgatggaactagattccaatttttaccttcctgttgtttatataagtggtttaatttcatctttctattaaaaactttttaaatactatgagataatttgagagagtgttatagatcttatatgaaattaacatgattttatagtgcttt

SEQ ID NO: 17599 - DNA, 1175 bp, Mus musculus
ttgttattgtttgttttgttctgtttttgagacagggtcttgcccagtctggtctcaaatttgcagattctcctttctgcctttcaaatcctgagattatagtcaggccccacccaacctggcttttgcgagggtgggggggtagtcactgggaaagacaccttggagatattaacagttgaataatgaactcttaaaaagcagtggttaaaccaacggggggggggggaatctataaaactagtctgaattaataaaagccttcagatcacacaaaaactggcagttcttgatatatttggaactggaaggggaagtgcattgatgtggatagaggtgcaagactaatatgttagtttaagtctttttaaggagcagtagggtatttccattagtttccccatttcactctcttgagtgattgtgttccccaagtttaaaagactagaaagagcacagaggagaaagaagagaagaaaaaagaaaaaaattagaggcttattttgacaaaggtttttttttttaaatatattcttcgaatcttttgcgctttgaaccatgttactgttacctactgaataaacaaatgtccatgcacatggatgataatggaaattctcgtgccagtgatatgctgaaaaatgaaagctctcacaataaaaggggatctcagaaattatagtagctctcagtgcttccagcccttcaggtcagttgtgacttagactgcgctccaggctttaatttggctttaagttttctcagactatcttcattataggattctggctgaaaatgaaaaaaaaaatcccgggatagattttctctgtggttcagggtgaaaaatcagttcgaaatttctagaaatctgccatagcttaactcaaaagtagaagtttgaaatgttttggtagccaaacccagagtcgataggatcacatgacaaggactattgttatatgaaggagagaaaaatggaatgattgatttaatagcttcagggaaaataattaaaaattgttgagattgtatcaaaaaaggaataacaaaggaacttatttagtagaaattaagttgggctggttaagaatggagattcttataaatatattccaaatatatttttaaaaggtatagcatcttgttttggaatgaactactttaaggtgtctgtg

SEQ ID NO: 17600 - DNA, 1183 bp, Mus musculus
gttaatgaaatctcagttaatggctttgagtactgagtgctgataaaattgtgtctcttacgctaatactttggaaatcatttgacagctattacaatgatgggcaacagatgaggagaaacagttgtgtaactccagcccgactgcagagctgatgcctttgatgtgtgtgatgcaggtgtagaaagacaattttcttagtgtttctattgctgtgatgaaaaccatgaccaaagcaacttagggaggcatttggctggtgtgtcctgaatcccagtccattgagcaaagtcaaagcaggaactcgacagggtaggaacctggaggcaggacctgatgtagagaccatagagaaatgctgcttactggcctgctccacatgggttgctcagactactttttaatggaatccagaaccagtagcccagagatggcactgcccacaatgggctgagtcctcccacatcaattactaattaaggaaatgctctacaggctcccctacagccaaatcttatgaaagtattttctaaatcaatgtttcctcctttcaaatgactgtagcttgtgggagttgacacaaaaatgagccaatataatgataatatttgttatgtggcaggtgtgagtgttattgtgtggcaggtacactcaagtgcatgcatgtgtgtgtgtgtgtacgagtgtgtgtgtgtatgcatgcacaccattgttgaggtttgttgttatttaaggtttgtgtttattcatatgcattaataaactttaagttggatgtagatgttggatgttatttaaggtttatgtttattcatatgcattaataaactttaagttggatgtagatccagacattagaatgtctataatttaacctaatttaaggttcttttgttaattcttttgtagacttagtttatatgtgagcgtttatagacacatgtttcacttgggcatgcttattcagacgctggtagtgagggatgcccacagcagaaaagctaagacggtgattgtgcaattactgggttttacacaatcattgaatatcttagacaacttggtatattcttagaaagttctgataagcaaggacatttgttttactactgagtttatctaaaactaaaagtaaattaattcatgtttttgcccacattggtagcgtctcattcattccctc

SEQ ID NO: 17601 - DNA, 1840 bp, Mus musculus
cccacacagctgttatgtacaggactgcattaggacatcagctggttttattaagtctgtcaataggaacagattttgtggtacaaaacacaccctgtagttctctagtaaaaaagcctacataggattactatggttggcttcaaatatacaggcaggtaagcacagaaccccgcccttctaaagttaaaagtagataagcaatctggacaaagggtttcacaaaatccaatacaatcaaaacggcttcaaagcaaaaacacaaatgcatttaatttgaaaagcatcgaaacttgaactacttaagcatgaagcgacttattgatacttgatccctagcatttattacaacactttaattcctaaggcatcatctgtccttaaaaaatgggggcagtcaaggtctagtttttgctcatggttaaaactaatttaaaattatctttctagtctagttgttctttcagtgctaacagtatccacctcccatcgttgctttcctgaataactctcaggattctccaaaaagcagcagaaactactccagaaactgaccttttctctaggtgcagataggtgacttaggtcattgatcctgatactcttgacttggcacgtggttgtgaaatagctacaagaagaatataggtctggagcgaagtctgatgttctagaacaaaccttgtttcagggatatagttagagagcacttggcatccaaagtttccttatccacggtaacatgtgctgtgagatgtcacatttgacttgtctcttaatggagtcatgtgttaacaacagcactgatgtcatgttggcaatgtccagctcactctgaggaagactttgtattttcaactctgagccgtttccttttgtgaaacctccaagcaattaggtgttggaagtgtgagttacatattctggaagtgtgagttcaatacttgagctcctctttagcggctcttgttttccttttgctgccaaggtgtgactcatagccgtctatgatgctgctctttcacgtcgtaggtttattccaggattcaaatcagtaacttggtgattacaaggtgctgagtatgttggaaccattgcaatacacctcaaagggaggtgtcggattttgactttttaaaaaaaattttcatttttctcttgaatttcatatccatctatccactcatatatgtttagcctacagaattacaaactagtcctgtttctgaagaggttctttagcttgaaatgtaaaggactgaaagatttgtaggtgttgcttttgttacttcacactggaactttgaaaatgttttcatcaaataaagttttgttttctacttttaatcctatgaattttaatgtctatgtttaagttagcgtgtattcttgtaactgtgtgaagcagatgataatttgctaattccatgtaatcagtgttataagaaacatcttacaatttttataatcaccggaacaatgtgaaaagccaataacttccattccatgcttgctacttttcaagtacttgagcactgattctctaatccttcacaacgtgatttaggaattttcttatattaattaaaaaaaaaaggttggaatttttgtggttcaggcatattttcaatataaactgcttttaatagttcaattgagtatttcaaagcaataggtttgaagagctaagaggaaagaatacaaatgcaaaataagatgtaaaccttaagaacaaagtgacagctgggaaaataagatgagtttatttcctgtacactaatcatatgctttattgaaatcactgacagacatctgaccacttaaaacttaagcttacaga

SEQ ID NO: 17602 - DNA, 1171 bp, Mus musculus
gaaaactgacaccaggatttgctttcttgttgtctacaaaaacaaataagaaaaaaaaatcaaaagtggaattgtgttttatgaaataggtaaaaagtattttgccttacttttgcctatatagtgtggcaaaataaaatttccaaatgaaaaataaaacctagggtactttgtggctctaagttctatgaaaaggcctcactgaggtaataagggttgtacttagccactaatagattagctactacagagctaagccctttagaactagtgagcggattttaataaaatgtatcactgtgtttatgatccagggttctcttgttcatcttcccagaaatacacggtcacactgtgaattgcatagtgagaaatattttgctttctctcaggtattcaaggtaagaaagtcatggatgtggattcagaatctcttccttcctccagcaacgtacacagtgtgtcttccaacctgaagtcatcaccccacgagaaagtgaagccggagagagagccagaggccgcgcctccttctccaagaactctactggctattcaggcagccatgctgggaagtagctcagaagatgagccagagagtagagagggaaggcagtctaaggagaggaactcaggggccactgcagatgcaggttccatctcaccccggacctgtgcagctattcagaaagctctggatgatgataacgatgagaaagtgtctggcagcagtgatgatctagcagagaaaatgctgcttggaagtgggctggagcaggaggagcatgctgatgaaacggcagaaagaggtggaggcgtgccatttgacacagcgcctctcacacccagtgtgactgaggtaaaggagtgtgtaaccagtggcagcagtgcaaacggacagacagactcagctcattcatttacaaccgcgagtcaccgatgtgatactccaaaagaaacagtgtctcttgctcgtgccgtgaaagaagcatctcagataagcagtgaatgtgaggtggagggtaggccagctgccctctcaccagcattcataggaactccaagcagtcatgtctctggagtcctcagtgaaagggaacccaccctggcacctccgacgacaagaacacattctgatcaggggatagacatacaccctgaagatcctgag

SEQ ID NO: 17603 - DNA, 1143 bp, Mus musculus
tgagaaaaaatatctaatgcaataagtttgcagccagcctgaggtacatggagattcatcctgagatacatggagatcctgtctaagaaggaaaggagggagggagggacaaaggaaggaaggaggaaagaagcaaaagagaacattaagttgaaaattgcctgttattttgaattaacaaatgcccttttacaataaaacaaaacaaaatatagctaattatttagcactacattcctgaaaatgcattctataaagtaacataattctttctgaaaggaaataaacaccatggtggaattaaagtctcagactcattctcaactgaaacaagaaacctatcttaaagatagcaatggccaaatatccttttgattcctagggacagtctgactccagagttaacaggcatttatctgccacgttaacccactttttttttttacttttttattagatattttatttatttacatttcaaatgctatcccaaaagttccctgtaccctccccctgccctgctcccctacccacccactcccacttcttgccagctctggtggtgcaggccggtaggatttgctgaaggaggcagaggcaggaggatctggagttcgaggccagcctgggttaacccactttctaaaagaagtaatttattttggtcttcctgatgaaagatgaaacattttttatgaaaatattaatagggtcacatgcaaaagaagaagtaaatcacatctatgttcttaccatcaggaatgctcattgtcagcccttcgtctgcactcccaaggctttgctggggtctctgagatactccaataaatattagcagtgaaatgcagtgttctatgatcacttgtctatcctttttggctatgttcataaagaatttcaccaaaagtaattacacacacacacacacacacacacacacacacacacacacaccttttcatctttccatgttgttttgttgttacgtataaagttttatcagttgcccccacaaaatggtgactacgtattcaacaccacatactaaatgaatgatttactcattatctagtgattttagaattcagccccagtcctggtcaaataatattgaggatagaacattaaaatgctcttttccca

SEQ ID NO: 17604 - DNA, 1163 bp, Mus musculus
agccccttagctgacctctggcttttcacccttgctgttactgcaaggtgtccttagctcaataggctgtggaaaaaacagggatgaggaggaacgacttccagctcctattttacccacaaatcgtggtgttattaacgacataattcttgcttaggctttgctaattctgaggttgataattctcctttaggagctgcacagcactcagaactgtgcatactggtttgtgattgtacaaattcagtatgggcaccgcttggtgcagagatacttactgcaagggaaggtccggcttgaccatttctgagtttcctgtgagataaacccggtttgaaagaggttggtaccaaattttggttaaaaataaaaaatattctccggctctacctcgcctccccaaaaggtaccaagagccacatgtgtgggttttacccacgggaggaatcgggtccatgtccacccaagccaaggttaaaagcccactcatctacggatgagaaaatcatttgatcacctcagttaagcgttgccttatttaacttaattaataggggggagagagattggagacttactattgaaagggcaagcccttcactgcctcccacccaaataaaaaggccaattggccttgtactacaagagccggtcactccttctccctgtttcccacctatcttccaaaaatgctaaggaattcaacttagtgttattttcacatcgttcagtcaaacttagccagagttccaaacgccctacttaaaattcaactagaaagttacctaccaagtactaattagcattataaagtcagagtctgcagctccaggcctttcagttagttgtttactagaaaggacagtcttaagccagatacagtttaccataagaaaagttaaagattcccagtgaagcaagttttttctttagccctagattccaggcagaactattgagcatagataattttcccccctcaggccagctttttcttttttttttattttgttaataatagggaggagatgtagtctcccctcccccagcctgaaacctgcttgctcaggggtggagcttcctgctcattcgttctgccacgcccactgctggaacctgaggagccacacacgtgcacctttctactggaccagagattattc

SEQ ID NO: 17605 - DNA, 1491 bp, Mus musculus
caccgggccattttccaaatctgcgtcagaaaagatgcctcccatgttggtatctgataatatcagtctctccttatcagaggagagaccttttatttttaacatgactacagacctatttttagataagttttcagtacaattttgaactacaacttttttaacaaaacatcttccagtattgggaaggttattaaaaaaacaaaaaacaaaaaaacaaaacaaaacaaaacaaaacaaaaaaaacaatgtttgtaggcaagtccactgctgtcattgtcctttgtctcccatagccccttctgagctctcctgtgcccttgaggtttggggctatctgtagtgtagaatgggtgttttgtgaaactggaccagtctgccttgccatgagctgttgaagaaaactcctgtcctcctctcccctccctacccccacccccacacacacatcccactctcctgtactgtggtccacatggagatctcaggagagaggcttccgacacacaggctcatccatccatcctcctgaggggagacagtaaagcaatcaggggtgccctgggagtttctggttgtatcggatgcctatactaagcccccttagtaagatttcaggtccccattggctgggaaagaaagctgtttgtttttcttttgaaccatggaaagaccctcttttgtgaagacgttaggaaaaagaaagaagggacatcttcagaccacggttctggtttctgctacacaatgtgaaatagctcggagtgtaaccctctgtgacggtcgctgtctcaggaataagcttgggggtctccaatgcttggggattcttggagtctccaaggtgataatcacaagagttttatttctctgttaaatgtatctgtactgtttttaattaaactccaaatttcatttaaaaaaaaaaaaaggatgtttgaaagtagctgggtgtggtggtggcacacgcctttaatcccagcactcgggaggtagagcagacagatttctgagtttgaggccagcctggtctacaaagtgagttccaggacagccagggatacacagagaaaccctgtctgaaacagcccccacccccaaaaaaagaacgcttgaaagcagttcactgatgatccctgaagcatcattctcagtcccttccaatcatcagtgactattcaccatttcccccaaagattccaagtcgtgtggtgaaagtgcttggtgcaaaagagaaaaagtcttgaaggaagagtgttatttttatgatgaaatagcattctatgaaacttcacattaggagacgttagtgaggaagagtgccctgagttgaataagcaaggtattgttataggacgtatctctagatggttccccactgaagagaactgaacattgtctccagcttgcaacctctagaagtttgcactatgcactctgataacaacataaacttggagatttgtccacaaaaaaccttaagttgagaaa

SEQ ID NO: 17606 - DNA, 1234 bp, Mus musculus
tgtttggatatattttcctgtttttctttaaggacttctacctgtttggttgtgttttcctatttttctttaaggacttataactctttagcagtgttctgtatttctttaagtgagttattaaagtcctttttaatgtcctctaccatcatcatgagatatgcttttaaaatccaggtctagatttttcagtgtgttgggtgcccaagagtagacgaggtgggagtgctatgttctgatgatggtgagtggtcttggtttctgttactaagattcttaagtttatctttcgccatctggtaatctgtggagttaattgttatagttgtttctggttagagatttttcctcttgtgattctgttagcctctatcagcagatctgggagactagctctctcctctgagtttcagtggtcagagcactctctgcaggcaagctctcctcttacagggaaggtgcacagatatctggtgttcggacctgccccttggcagaagatgaaggcctgaaacaggacctgtcccataagctctggtgcttcagtctgtcatagaagctgttagcttctttagtccacactcttacttgtgtagactagtcttggagggatctgggaaccaagatggtcccccaggtcctccggcaaagccctccagggcagattggacacctctcctctggcagggaaggtgcccggatgtctggagcctgaaatggggtttgtctcagaagctgtcctctaggggaccttgggggtgtccaccgattctgaacccaaggtgacctggtgctggagctgactggaagggacttgtgaccctggtcaggtcgggtttccttttttcctaatgctgtctcaggtccctcgtgattggattagaacagaagttgtgttccacttaccagtggtcctaagatcatgtggagagtcctctaggggaccttgggtgtgtccgccaactccacacccaaggtgacccggtgctggtgacgactggaagggacttgtgaccctaggtaattttactttttgctgatagaaaataatttttaagtaggtaccttacagtcgggaattcgtagggaaaaaaataatctgctggaaaaatatttcccaactaaatgacaagcatgagattcatgtccaattaatatttttcctttttctttttgttctgaaattggcataatatgctttgatttgtggcctgggactgtgagcaagaggtta

SEQ ID NO: 17607 - DNA, 1105 bp, Mus musculus
tgtgacaggggagcctctggagccacacagaaatcacactgggcaaggaacagactcgggatacagaatgtcctcagccattcagcaccatccggacaagctcttcatagttgatgcaaccattgctgtcctcatgccccgccactagcatctctacttcttcctttgtcatcttctcgcccagtgtgactaggacatgacggatttcagcacccatgacggtgccatttccttccttgtcaaacacacgaaggccttcaacataatcctcgtaggttccctggtccttgttcttggccacggtctgcagcatgggcaggaagtgctcaaagtccagcaccttcacattcatctcatcactcttggggttccccaggaccttgagcacctcggcgttggtagggttctggcccagggcccgcatcacatccccacactggctgtacaggatcttgccatcacctgttcggtcaaacagcttgattactgccggaaaaggtccagcagagctcatcagccaagatgtgtgacttcaccgaggaccagaccgcagaattcaaggaggctttccagcattggtattattctaagcaaaatgaaaatgaggttgatcattgaagaataagtattttgttgctcataggttaacacagctatgtcaacagtctatccctacacatggtgtgggaaaatgagtttaagcaacttttatccagatagtcaatgaatctattattttcaaataataagcctgtagctattttactatgtaaaaaccaggatcattaatttttttccaaatatgactattttgacaccccaacatgcaagtcaggacttccatctggacaggagtttgcaaaggacttttaacaagcccagcagaacccagaatttgctttctacagaaatgacaaacacgtgaggaactactgtgagtcttctgcttgtcctgggaattcaggaactcaatgtgttgttcaaacaaacttgtgtaagacttttgactcaagaggggaactcatctctccagcttctcaacagttctctaagcagcaaggttacattgtttacaaatctattcaccaacttactctaggatagg

SEQ ID NO: 17608 - DNA, 1175 bp, Mus musculus
aacttaggatacccaagatataagatacaatttgtaaaacacatgaaactcaagaagaacgaagacaaaagtgtggacactttgccccttagaattgggaacaaaacacccatagacggagttacagagataaagtttggagctgagacaaaaggatggaccatctacagactgccatacccgggaatccatcccataatcagcttccaaacgctgacaccattgtatacactagcaagattttgctgaaaggacccagatatagctgtctcttgtgaggctatgctggtgcctggcaaacacagaagtggatgctcacagtcagctcttggatggaacacagggcctccaacagaggagctagagaaagtacccaaggagctaaagggatctgcaaccctataggtggaaaaacaatatgaactaaccagtaccccccggagctcttgtctctagctgcatatgtatcagaagatggcctagtctgccatcagtggaaagagaggcccattggttttgcaaactttatatgcctaagtacaggggaacacaagggccaagaagtgtgagtcgggggaggagtaggagggcatgggggacttttggtatagcactggaaatgtaaatgaagaaaatacctaaaaacacaacacaaaacaaaacaaaacaaaacaaaaaaacagacccaaagtacactgcccacaagaaacttagttcaaccacaaagacacacagactggcatgaaagagtagaaaatgatatcccaaacaaatgtaatccaaaccccagaatgagtagttacatataacaaagtatactttaagactaagaaaataagagtcaaagatcactacataacaatcaaggaatcaattcatcaagaagatatattgtttgtaaatagttattcatgtgatatcagttatcaattttataaaacaatactactagataaaaatggagaatgggctccaacataatagcaggggatgtcagtacctcatgcccaccaatgaactgtcatccaaatgatgcatctacacagaaagatcaaagttaatccacacggtaggtaaatggattctttacttacagtacattgtacccaaacactctagaaatatgaaaggccatgtgatgtgcatctgcacagtgttactacacagcttttttg

SEQ ID NO: 17609 - DNA, 1187 bp, Mus musculus
tagtaacgagatgtagtgtgaacattttccattaacagtaagtcagtggcttcaatgtgattatggtcctgcaaggtgatacttactaaaatatctaaatattttgttgttgtatctgaatcattttttttaatttattaagctggaagtgatgaagtgctgttgtttccattgtcaacaatggtgtgtcattttatatatgttcctaatgctcacggaactctcccaaaatcaagttattcagaaagtgtgtggtgtgttttcattgtctgtctcataacactgaatcttcattggtactttaaagaggccagaataaagtcataattaagaacattaagtttatttaagccaaagcaaaatttaaacggtaaaatgtgttttattcaatctaacaagaagttgcaagagatgatgccacattcagattatgagtttagttgacacagcagtgccacaccccgtccaatccagtgttccttgggttggtcagagggaagaatcatggcaatcacgaaatttgtggagtggccagtggtggagagtgtacccctcctctcgcttgtcttatacagtggagcaacataacttggtcgtttgggtatgtctgactttttgcatggctttagccacatctggaagaaagcacaaacacctctaagtcagagccattaaccgtcatgtactttagctactgtgatagttccagagtaaggttatgtctaaaacctatgccctacatagattgtattttttgtcaacagtgaaatgattgtttgaatataaagatgcccaacaatctcagaaccagtatacaaagagaaaacagtttgcctctgttagaaacatagtgcccactcctgtatgctttcgatattatttggtttaattggactagccttggaaatgttaccatttttactctttttctacaaagaaagtattcttaatgaacttaattataacacatacttagttgtggtttcttaacaggttgtatgcaaaatgtttttacagtaaacagttactttatacaatactgcattgtgccataataaagactagttgcttaaaaacatattacccaactgttcatcacctcttccatgggggtgatttctggtgcttttagtaacaaaacaaaattctatatatttaccaaagagagatgctactatttatactca

SEQ ID NO: 17610 - DNA, 1250 bp, Mus musculus
gagcattaggaacatatataaaatgacacaccattgttgacaatggaaacaacagcacttcatcacttccagcttaataaattaaaaaaaatgattcagatacaacaacaaaatatttagatattttagtaagtatcaccttgcaggaccataatcacattgaagccactgacttactgttaatggaaaatgttcacactacatctcgttactatagtatttctaagcacaatcacagctgattgaatgcagtgtggtatacaccaaaatccttatggtgacagcattgtacaagtaacattggtgacctccaacaagcatgttaaaatttggctagttaagtggtatgttggagccaaacagaaatgtagtagaattaggattgtctagtgagacctgaaactatatgctagtatgatgtaaaaattacataatggtagaacactatcaaaatactagcagcaactttaaaagccccccaaaatgactaagaaaatctagcaaataaagataatgccatttgtttgagaatataaaactttggtctatggccataccaccctgaatgcacccgatctcatctgatctctgaagctaagcagggtcgggcctggttaggacttggatgggagaccgcctgggaataccaagtgctgtaggcttttccttatttataatagccagaagctggaaagaatccagatacccctcaacagaggaatggatacaaatacaaaaaaaatgtggtacatttacacaatggagtagtactcagctattaaaaagaatgaatttatgaaattactaggcaaatggttggacctggagggcattatcctgaatgaggtaacccaatcacaaaagagctcaaatgatatgtactcactgataagtggatattagcccagaaacttagaatacccaagatataagttacaatttgcaaaacacactctctctctctctctctctctctctctctctctctctctctctctctctctctctctctctctctccctccctccctccctctctctcccacctccccccacacacatgcacacacacacacacacacaaacatggaggggaagtgtggtgaggatggtaagggtacccacacgtagtacccatgtgtttcatagtgcatatgccaccaataagtctactgaggacagatgatagagctatgaaatatagacctctacctggacttagataagtttcagcaatacagctggattttt

SEQ ID NO: 17611 - DNA, 1099 bp, Mus musculus
gtctgtgtatttcctgcttcatattactcaagaggaaaatgacttaaggtatggcccccaaaatacagaatacaatcaccaaatacaatggaacccattcataaaaatctgacaaagaagtcaatttgcttttcatgtgtgtcatttacttcaatcttaacacatgtctgtgcttcttggtgactgcaaaatggtaaaatttaaatagttcattttaaaagtttcatgttaaaagtgaagttcaatctaaaaacaagtttcgctcattgaactcggaagcagcagcagctgtcgtgcattcgtgtggtctcatcatcagcacagccgggcctacacacaagcaaccatgtctaagggacctgcagttggcattgatcttggcaccacctactcctgtgtgggtgtcttccagcatggaaaggtggaaattattgccaatgaccagggtaactgcaccacgctgagctatgttgctttcatggacacagagcgattaactggggacggggccaagaatcaggttgcaatgaacctcaccaacagtttttgatgccaaacgtctgatcgggcgtaggtttgatgatgctattgttcagtctgatatgaagcactggcccttcatggtggtgaatgatgcaggcagacccaatgacccatccagcaggtccagttattcgagggtctcgaggggaccttctcctaagaaccaaatgggggggggggggttgagagacaagaaccttgtgtaatgaatgacacacggaagcagtctgagtaacatcaaggtcccaatgtattgagcaaggcccaaggcttaaatacgaaagcaaagggggaagtgcctttcagaaggaggggtggggcaatagaactgcacaagcaaaaggggaagtacttatcagtgggaggggtggggcaatagaaatttttcttttggcagctacacggggaagcaggaacttagtggtatcagggtgtggtcaggacatctggcgctgacttagggctggaacattctgtggttgttctcggaatggtgtgtcggtggcccacttttgacccccttttcttcttggagggagaggcccaattcagagat

SEQ ID NO: 17612 - DNA, 2656 bp, Mus musculus
ccataccaaacagaggtccttaggaataccagtcaggctgtatcctggagcccatctttgtaaacagtcatagtgctgtgtaccaggagcccctgatcagctctttgctgggttatgaccgttgaggtgacattcaggtaaaacttttaaatggcagagacccagcattgtttcagtcttgctgccaacaggaatccagagggcatgtttgtgaaacatgtatgttgtttatgcttcaatattacggggagtcagaaggaaaagtttttgttacagtaaaaacctagggaaaggaagaaaaagcagtgcaataataataataggcttactaggactggatatctgaagttgccagtctgtaagccttttagattttaagtgtctttgttaaggtgtgtttctcctttcagcttccagaaatgctgcatggagatggtgaccatgaggagcatggcttctgtccagttgggcagttcattcttcagaatttaggactgctgtttggattcgccatcatgctggttattgccctctatgaagacaaaattgtgtttgacatccagttctgaccattcccagcatctctgttgattgcgagaatgctcgtgcagcttgcctctgttccttgtactgtatgcacgtcgctcagagaatccagtggcctgcactatttacaggttctgtagatttgagcctaaccacgaaagactggtgttcagtactgttttctctgcatgaatgggtcttttaaaagtttgcgataaagtcagaacatggaactccgtgtaccaatattgatagaagtttaagagaatcatataaaacactagtctttttattagtagaaacttctgttgctatgcagaaatagaaattaaaccaaaaaaatcatttaaactttaaaaatattttaaatggacattgagcagacatttttgcgtgtgtgctatgaatgattttagtgccctctattcagctaaatacatacatatgggattaatagggatcaacttgacacaactttgaaactgtataaagttgattttaggaactagagggaagcccaggctgcactagagtatggatttagcattggggaaagcccttattcttgaatctagagttactatttttgtatatatttgcatagtgttcaaacttgcagcctaaactactgaaatttgtgattgtatgtttgtgtgaacttcagtttaatgaaagattcataatggttctttgcatactatacttggtgttggatttttctttttaactttgtttttatggggggggtgagtcagaggatgtagtcagatacctttttcttaacattactgctctagaaaaatatcaaacaaatggcattccatttccctagtactaactaggttaattggaaattttaagttctgggtgttcatgttattttaccagtttggcatttggaactcggagcacatgctgtggctggtagtaaaagccaagtttgccatgcctatagtctgtatatagaatgtcagctaaatgcttactgcactggtaccatagctactttggtaccaagtatatgactaagccaaaatcacttctatcattttgtgccaagatacactgctggtgcctgaaatggagcggtcagtgtttgggtgcctgctcttacaccactggggcagtgatgtgtgagaagtctaagtcacgtttcgtctgattgtgactcataacttgtagactagtcatgtgcatacagctgtttacatcccatgccacccactcttcatttatacaggcaaatgtctgaaccgtgtgcagctagctctattttaactgcttggcagccaggatatcccttgggaaaaaccacataagagccaaaccctggcctttccattttaaatatttttattcagtcccttctctggttcttttcctcttactctgattttccttttaagacaaaaacaaaaatttgagggcaacacatgcgaccaggtgtcagaggtcaatctccaatatttctttgatatgttataagcaagggttatttggtcttacagcagttgtctctttctcagccctccttgcagtaagtggttttgcacacaagttttcagcactgggcatgcctatgacagtcattacttcacctcattgcttggccctttgagcaaccttgctaaaaggtgctggtgtgctcagtgctgtcaacttcaagtgactgggatattttgctttcaaaaccaagatacacttatccttcagttttgagtttgattttcaaggagggttgtgcattccagcattacatctccttcatttcaaacaactgcgggaatatactcccactctaaaatgcttcacaaagctgttatgcctacaatatacaaagttttatattctcaaacaaatggtattatctttatttgctagattttcttagtcatttcagggggctttaacagttgctgctagtattttgatagtgttccaccagtatttagtttttacatcattctagtgtatagtttcaggtctcattagacaatcctaattccactacatttctgtttgactccaacattccacttagcttgactagcctaattttaacatgcttgttggaggtcaccaatattacttgtatgatgctgtcaccatg

SEQ ID NO: 17613 - DNA, 1200 bp, Mus musculus
acacaagcaaccatgtctaagggacctgcagttggcattgatcttggcaccacctactcctgtgtgggtgtcttccatcatggaaaggtggaaattattgccaatgaccagggtaaccgcaccacggtgagccacgttgctttcacagggacagagcgattaattggggatgcggccaagaatcaggttgcaatgaatcccaccaacacagtttttgatgccaaacgtctgatcgggcataggtttgatgatgctgttgttcagtctgatatgaagcactggcccttcatggtggtgaatgatgcaggcaggcccaaggtccaagtggaatacaaagggagacaaaaagtttctacccagaggaagtgtcctccatggttctgacaaagatgaaggaaattgcagaagcgtacctctgaaagactgttaccaatgctgtggtcacagtgcccgcttacttcaatgactctcagcgacaggcaacaaaagatgctggaactattgctggcctcaatgtacttcgaaccatcaatgaaccaactgctgctgctattgcttatggcttagataaggtcggagctgaaaggaacgtgctcatttttgacttgggaggtggcacttttgatgtgtcaatcctcactattgaggatggaatttttgaagtcaaatcaacagctggagacacccacttgggtggagaagattttgacaaccaaatggtcaatcatttcattgctgagtttaagcaaaagcacaggaaagacatcagagagaacaagagagctgtccgctgtctccgtaccacctgcgagtgggccatgtgcaccctctcctccagcacccaggccagtattgagattgattctctctatgagggaattgacttctatacctccattacccgggctcaatttgaggaattgaatgctgaccttttccatgacacactggaccctgtagagaaggctctttgagatgccaaactggacaagtcacagatccatgatattgttttggtgggtggttctaccagaatccccaagattcagaaacttctgcaagacttcttcaatggaaatgacctgaacaagagtattaaccacaatgaagctgttgcctatggtgcagttttccaggcagtcattctatctggagacaagtctgagaacattcaggatttgctgctcttggatgtcactc

SEQ ID NO: 17614 - DNA, 1101 bp, Mus musculus
caagtagataaacctggaaatgagtcaagggccagatttagtccagattgggtgcatatacctgaattagtctagacatcagacttcctattatagatggaaaggaattaagaaaacattttaaagagacataattcacaattttaaaacatacatttttctgtagtaatgcaatgtattaaattttaggagattactgttctaatttaggtaaagaaaaaaaattaactagaaagagaaagtcattttgtaaagcatacccctaaggctttcagaatggttcttagatgtagaaacagaaaagaggtagtagaatgatagagttgacaggcttcaaaatataaaatactgaattgttttttaaaagaaagtattccttagagacagaagagacaggagcaggaagcatgaatgagcaggagtctgccagcatatttacaaaacatgcctttttccctttgctatcagctcttaaaatacgttttttctcctgcaataatattggatgtagaagcaatagcctgctcagtaggtgtaagctggctgttgtcatgagtttttactgaaactgtcagggacaagaggaaccagctacttattgaagaaagatacttttaaagtctctttttaaaaaatcttagaaataattctatatttctgaacttcagatcacaagaattccccaagcattttatgcaagaaaaatatctaacttttagatacaaaataccagtttcataggtttttttttttcatatttgtcagatgaataagccagtgtgctttccaattagttgtttttataaccgtgtagtgaataaaatattctaaatgctttccaaagcctgaatttggtgcaatgataaatgcagtcagacacttctcagatgaaaattatgcttttcaatgcactgtctaaatgcatgaaatgaaaagcaccagtcctggtggtgttagggtgagaatccaaccagctctcactagtaggagatggtaagttcctatgtgctgctttacttgctttcacttgtattccctttaaattgtaaataactgcataagtatggtgccactgtatttccttgcctgcctatttgaatt

SEQ ID NO: 17615 - DNA, 1208 bp, Mus musculus
tgactctgtttagagattgttcttctggtgattctgttaccgtctctcagcagacctgggagacagattctctcctctgagtttcagtgctcagagcactctctgctgacaagctctcttacagggaaggttcgcagatatcttgtttttggacctcctcctagtcgaagaagaaggccgaaaacagggcatctctcagaagctgtgttgctttggcagttcccagaagctgtcagcttctgtggtgcagactctcccctgtgcagactaaattcctacgttccagggagtcctggaaccaagatggcgactgctgctcctgaggctgaggccgcctcccgagccaggcagacacctgtcctctggtctggacggtggccggctgtctgcagcctgcaaagggtactgcctcaggggctctgtgcttccgcctgtcccagaagctgtccggttctctggcgcaccctctaacctgttcagactaatttcctaagttctgctgagtcccggaaccaagatggcaaccactgctgctgaggctgaggccgcctcctaagccaggcggacacctgtcctctggtccggatggtggccagctgtctgtggcccgccaagggtgctgcctcagcggctctgtgcttctgcccgtcccagaagctgtctggttctctggcacacactctaacctgttcagactaatttcctaagttctgctgagtcccggaaccaaaatattctttaatggtttttctaaactaatttctgagctttggatatgggaatcttctccttctattcttactattcttaattttggtcttgtcaacatgttcagatttcctggacgttttgtgtcagaaacattttaggtttaatattttctttaatcaatatatcaagttcttgtattgtgtcttttactcctgatagtctctcatccatttcctatattctgttgacaatgtttttgtttgttgttccagttaacttacctatgtcttccttctccaagattccctcagtttgtgttttcttaattgcttctatttccattttttgtgtcttgaacagttttgttgttgttgtttgcctttttgattatatttccctgttttcctttaagggatatattcatttcccttttaaagtcctctatcatcttcataagattaggtgtaagatcatattcttgtgcgtcagctgtgtta

SEQ ID NO: 17616 - DNA, 1220 bp, Mus musculus
aaaccatctggttctgggctaactttggtacctggtgtctgtctagaaaatcatccatttcatctgtattttctagtcttgttgagtataggcttttgtaatagtagctgaaaaaattttttaatttcttcagtttctattatgtctcctttttcatttctgattttgttaatttgaatattgtctccattacgtctggtttgtctggctatgtgtttatctaacttgttgatttttctcaaagcactgtcttctggttttgttgattctctgtacagttatctttttctacttggttaatttcagccctgatttttattattcctgccctgaactcctcttgagtgtatttgtttctttttgttctagagcttttagatgtgctgccactgggtttgaatgggctttgacattccaaaagaccaggctaaacttgttctctctctctctccttctccctctccccatctctccctctctccctccccttttttcccactcttgctctctccccactgtttttccctccttcctctatcctctgtctctgtctgtctctctgtatttccacctctctgtctttctatctgtctttctctgtctctgtctccccccccctctctctctctcactccctccctcccattcctcacctgacttcatcctgttcattgatgtagcctcttagatttgtcttcagcatcatgcctacttgttgtctcatttcccaccatgatgctcattgattaatctgatgtgtgtgatggctattcctgattgtgaacttgactacatctagaatgaactacaatccagaaatggagggcacaaccatgatccagttcttgaagtttaaatatacagacttcttactctgatcttgaggcatagccccatgcaaggtaaaacacgcctttaattggaatcacaacttctgctggagacctagacaaggtcaatggtggaagaaagacatactcttctttacatgcttgcattaacttgtgggtataactgctagtacctaccacttcaggattcctgtctataaaaaagaccaggggaaacagctatccctttggactaagcaactactagacttttgtacttcctatttatagctgcccatgttgtcttagttggattaaagtctgtaagtcattacaataaagtcccttaatatatagaaacattccataagttctgtgactctagagaat

SEQ ID NO: 17617 - DNA, 1690 bp, Mus musculus
ggtatcacttgaaaacctgtccctgtttcgagggtgagttacttaagacaccagcttatatatagcctctgtgagtctggcttctgcataaactttgtaatgtttgtcataatgtttaatggaacttgtcttaaacttgaatattgccacctgaagcaataaccaccccaagccagaaacttggacagcattgtcaacatttttgagtattcctgatctaggaatggcttgactccctagagtgtctgcctgccataaggattttttcacagacagaatcagaatcatcctaaactcttgtttattgaccagataaccaaattcttcatcagaattatggaataaaatatgtaatataacaagtaatttttagaagaaaacggtttaagatgatgctcttaacatttgttgcaaacattgaagtttacattgaagaaaaatttacaactgagtccctgaatgctttatttttgaagttaccatgttaaatattgaagtgtaattggagggattgaagagagctataacacctttattggacagtggtctcattgatactagttgtatttttgaggcagggtctttctctgtgcagccctggttggttggaacttgttatatatatatatatatcaggtgggtctctgaactatagattgacctgcctctctcttcctggagctgggattaaagttgtgtagcaccacacaaggctaatctgattatttttaaaaaaatactcatggtagttactatagcaaatacaaatcaaattaaattcatatagccatgtgactaccagttgcaagtagtcgggtagaagtaggcatttcctttcttccaggaatgtgtgtgtttaaagtttttgaacaagtcacatagccttactagcaaaagttaaatggctcaagaagtgattatacttctgttgaggtgggatttgtgtgatggaacatcacttacagtgggtgattggtaatttttttcattgttagtatttgtctctccttaaatattgtctcttgagtaaaacttgctgtaatgatgacatatctacctacttatttttactttcagtaaacatggagagcccagtccattttactgaagttgtattcatcttcagcttgactgctccctaactctgtacctgtcatttctccttacctcatattgtaaaataagtaagtttctgttcaacttgtatagcatttgaatataatttgtgtcagattttgatctaattcattttaacagattttcagtaagcactgcattaggctctgtgtggagattatcatagcattttgagaagtcacaaggaatttggtttataggtacagggctttgacatttgtcattgttcatatattaataattatagctaatttggccttatgattttttgtttacatttctgaatgtttcaaaaaagttaagggttaagatagcttgtgttttgtgattatagatgttttgaataaaaataaatgacaaactaatcttaaaaatttaagatataggagtaacagaacttttatttgtggtacaatatggtgttaaaaggtgattctaaagaaaggatttgaactttgatagattttaatatggtgaggtatatctcagtgggccctcagttctgacttcgttttcatacctatgatgctgctaggcaagttgtgatgaggga

SEQ ID NO: 17618 - DNA, 1996 bp, Mus musculus
tactgtcagcttatcctaccctactgggacatggcgagcttcttttttttttttttttttttgcagctagctgatgacatgtgggagcaaaatgcagtcagttctcatcaaacatgggacggaaagggttaatgagtacccaccacaatcagtgtctgttatagaaagggagagctagtgtccctcgactgcgccccccccccccccccgactgccacttttgtgtgcgcctgagtgtgtttggttctcttctaggttcctggtacagttcagacaggacaaagtatgtgtgaagtttattcaaggcaaccagaaaaatgggagcgtgccaacctgcaaacgaaagaacaacagactccttgaagtcgctgtcccttaagtgaggcttcctctctgctctcacggacttgtttcctcgtaacagtgcaattttactttgttttatttggggttcactgtatgtttgggaattgccaaaggctaactgttagcgtcctcttggcacaattaaaagtatttgactaatgagttttaattatcagaatagttcattcctaagtccacattctgtcctgggcagaattctagaaattaacagtgtctgtctccatggtttatgtgttttctccttagttacctagacttgtgtaccctaaacccacatattacccataaatcactagtacatgtcagcacaggaggggagcttacagtcagttatcagatatttattgaatgcctactttttgctgggccctgtgctgaacttattcggagatttctatttttaaagctgttgccttctggctgatttgtgctgtggaagcaacagctaagaaagttgaagagattgggtcaaatgagactataaatgacggccactggtaggaacccagtagtgtggcgtaaacagtacactcactgagaagtagaggtcctgggtggattggagataggtaattgggtagaattctcctgagaggtttggagatagatgattgggtggaattcctctgtgtttgtttgtttgtttgtttttcataaatctatttgaaaaagagataaccaacatttaaacatacacatttattggttcagatccgttttcactttagaaaaagtcactgaagcagggctgtagaatgctttgttcctgttccagagaagcatgagataggaccctggatgtgcacagtgtatccacccagggtcattagcttttgaaactgcatgataagaagaggctgagagccgttcagactggcagatcttctctttgatgtgcaataaaacatccaagatcacttttgaaagttttatttataatatgcattttttttgtatgagagagctgattggtacaaggtgtgtattttagtcagatcaaaattaagttagaattcgttttcagggctttttgattttttttcttcaaaattaacaataaggattcattttggaaaccacattttaaactctggaattaaattgtttcttatttgggaggataatgtaaatacattgggattatgttaataataaaattgttctaatttggtgccatttgctggattacaactgtatttttgtatctcaagctattttcatacgttagtgtcaaagtgatgtgtcacagaaaggatttccattcagatattatatggtctctgtgttaacagatttccactgatctttttgtaccactatcagtcaatgaaaaagttctctggggattttcttttgatttttgtacttaaaaagaaaaaaaaaaagttctgataaagaaattctccgaagtcttcgtgtttattggtacaggaaatggatatgatcattttttacagttcctaaagtaggtaaattcataattcctgctataggtagatggaaacttcggactgatcactggtattttgaaagcatatacttatagttagctaaatatacttacaacagtcaaaaaaccctggtcagtaccaaaggctaccaactgtcc

SEQ ID NO: 17619 - DNA, 1137 bp, Mus musculus
cagatacacatgcacacatatatcctgattcattgtgaaaaatatttcaaaacaaaacaaacaaaacaaaagaagccctcttcgtccgttataaataacaagatctgccttcagcaaactcccatagccagagcctagaacttcaagaaagaacagaacttgctgcaccaattagtgctaggccgtagtatgaacaaagcaccgcaaataaactccacaggcctttagacagaaggttgtgtttgtaattaactccaacgcactctcattaccccctccccagagctccacccagcccagcgccctgcagggctcccgttcccagtctggtttccattcgagccccgcccccttccccttgcctctctgggactgtgaatcaatcccatcccgggcaggaaacgggacccggggcagccccctccgctgtggcggaacaaaggagcggagcgcagctgcactcgcagggcgatccatcgggtccggtcgcccctccgggtgcgccgcggccggggcacaccgcacctgaaccccactccccaggacgccccattgttccacctccgcctccacctccgcttctccttcccacaggaagccataagcttgtccttccatagaacctggggccgggaaactccagtgggccagagggatggagggggatgcgagtgggcccgcgggaagcagggttccccagtgcccgtaggtaggaagccaataacacaaagtgagagaacaacttagtttgtaagccccttccctctcctgccgcccccgaagccacacggggccgcgatcaccctcgacgacctcgagcgcgcgtgggttcacggtggagtgcctccgcgccccacaggagcgccccgggagctgatgacccgggattgcaggctgcggctgagcctggggccgcgcgcacaaaggcacgggcgggaagggagccggcacgggggagtgcagcgtacctcgcccggcaaccgctcggccactccgtctccgcgtgctgctcgctggccgccgcctggggaacgcgggtcagatccgatgcggggcttgtgccacagttgctgccggggatcccgcgccgctcagccgaccgtgcgttcagtgcacccacaccgcgtccgccggctg

SEQ ID NO: 17620 - DNA, 1220 bp, Mus musculus
tttttctgttccttcagttgctgtaaaagaaggaaccgaatggcaggttaatcattagagttgatgtgtttattcacagatcagttcccagtcataactagaaagaaaggtgtgacaacctcctaggaacaagagggggaagtgcctcttcctgaagcctggcgaagtgtgagtaatctgagggaggggacgccccagaacctaggtctgctgctcctgcatgcaatgggtgcccagcaccttcagcagcgatttcatggcccaggcacacgaaacagcttctgcagtcttccagcctctgcagtcttccagaccaggctcagcacagcaggctgacctagtctcctcgttcagatttcaatccttgagatttaaagggccaatctggacacgctcagatttccaagctggacggaggccctcgcctcacatgtcactcccgagctctgaaatctgtagctcaccagctggtacccagccccaacactgggtttatggagaccagaggaaagtaccacccttctacccaatggaacgaggcctcctgctcttgcagcattcgtggtcaagctgctacacacttggaaggcaggagaagtgaggactgaagtggggaatggtttccttagaatgctgctggaacctcaggggctgctcgcagaggaggcggcaagtgcttatataatttatgcacatgcaagtttataaagcactctactgaggtccgtacagcccctgtcaaaacacacagccaggagactcaggagatgaagaagggaccagcatcccaccgtcgggaaagtatgggggtcaatcctataagacttccaaaggaccagagatgcatcaagacatcaaactgctctgcctaccaggtgtcggaactcagctgccagacttccgttggtggattcttccatgttcatcacttttgtgtgcgtacccaagatgttgaacttccgaaatctatacaacgcaagacacaaatccttaaagtgcttcaaactactaaacaaacaggataagcaaagtagggtgcagatgctatacctaccctttaactgtgtttttctcgttcacatctctgtaaaaaaatatgtaaatttgaagtaagattcaatagatacaaaacagatgcatatgattacacagtcatataaataaaagagaaaatgaatacattggctgcgccgggggagggggggaaactccctgtggtt

SEQ ID NO: 17621 - DNA, 1099 bp, Mus musculus
tcctaggactttctgttttctttggatagattcagaaaagatagtcttgtgattctactgatcttttccaatgaaacaggaggtctggaatcaggacctaatgcaggcagtgggcactgaggtctgcctgctttcctttttcctggtggttcatttcccctgagggatggggctgagaaactgatcaagggggaaagcactttgcagccaggaaagctcaagcagggcagcaccagctacagggatttaggcagtaggatagttagtggggaagagacgggtgggggtgggggagggggggatggagaacccaagctcggaggagcagtgcacacccagaggtggggatctgggctccaaacaggagcgaactgaagcacagcacattccctggagggctggagggaagaacagcgcgcagcatcttggtttcctttcaagaattgcttgttctaataaaacagtgtttgtctatcttaaaggaaaagcagaaagcgagccgatctttaatgacctgatctgtagcctgagcttagttgtgtgtgtgtgtgtgtgtgtgtgtgtgtgtgtgagagagagagagagagagagagagagagagagagagagagattatctatctgcagacaggccttgctttgcttaagattgaaagcttttagagaagtttgggctagagttagcccctgatgggacatggatatccacaagaatgttgttactaaatagtgaagaccgtgtttggttttcctccttttaaagcaggagtgtgatgcctttaaaaaagtatggcaggctctctgactccccctgggctgtgtctgccttgctttagtggtctctggggcgcctgggactcactggacctcactggtttcctccttgtagaacctgacttccatgccgtggagccctacacgaaaaaagaactttcagctgttactttcccagatattattcgcaactacaaagtcatggctgccgagaacataccagagaatcccctgaagtatctgtaccccaatattgacaaagaccacgcctttgggaagtattattccagaccaaaggaaggtgagtgcctgagcgatctggggtg

SEQ ID NO: 17622 - DNA, 1276 bp, Mus musculus
atggaggaatgtttctgtcccgggagacattggcacttcccctctcctggatggccggaagtcttccactgttttacatatggcacagttcaaagtcaactttagatccaatgctctatcaaactatagtgggcatccttcatgtgagtgggaagaaaacaaccgtgctccttactgcagcttctgccaaggcatggttgctctcctcagggactagctttgttggtggcaatggctacacaaaactaaacaccaacagaagtaagaccattttcatgagtactccatcaagttaaagggtttttgttgtctttttggtcatggattgaataaaattgtctttgcacatccattaagggggccagctttcttaaagcaatttttctttttttttaactaaaattagatataggtgaactcatgttttttagtgggctgaacttatcggttttagctggttgtcttaattagccataaacttggagaaagcagtgacttcttgaatccttagccaaatatgagtatcagataattttattatttttttttcgagacagggtttctctgtgtagccctggctattctggaactcactctgtagatcaggctggcctggaactcagaaatccgcctgtctctgcctcccgagtgctgggattaaaggtgtgcaccaccaatgcctggtgagataactttaaagaactccctataaatgcatgagaaccactgttactgatgaatgtggttttttgacaactacattcacaaatggcctgtcttgtgttttgtcaccgttttgagggatgatgttttgtggcacgtgtgtgatcacagcctgatggttctggtcgtgggttggttcttctgggccagctttcacagactgctgcgcagctgcacctacagtgctgccccataatactgtttcactttggtgaagatcagcccaccttacaccccgagtgcaggtgtgaaccacggtaagtgtgcacagtccttagggaaaacagggacgcagaggcctgcctcctctcttttccatgccaaaatgaaatgaccaagaaacaaaacatttaaaaagttgtttctaaatgctgagacctaaccattgcttatatactgttgtctgttgaaacagtttgttacaatttcattctgttgaactaggtgagactttaagaaatgttgaaattatgttaatttcctattattatttaatataaagatatttaaaatgtctagtgttatgagttggtttaatatatatctcatgtat

SEQ ID NO: 17623 - DNA, 1188 bp, Mus musculus
gctttcagttaccaaagttataacgatatatttaggaaaagctacaaataacacttactttgaatcctgctgtcaaatgtctgcatcaagatagcacccctttgtgggaggccctgagtatcttctcttcctctactgcctaactgttggtgggctgtatcattcaataagatcacttcattttcaacttagacccaccgtttcttttttgttgttttgttttgtttggtttggtttggttgggttgggttgttgtttttggttttttcgagacagggtttctctgtgtagccctggctgtcctggaactcactttgtagaccaggctggccttgaactcagaaatccgcctgcctctgcctcccgagtgctgggattaaaggtgcaaactaccacgcctggcagacccaccatttctttgctttggaaaggtaatttatgattaacttagataataggtaaaagcgaccttacaaaaaacataattatctaggagtcccacatactggacctaccctattatacctccaagagataaagggtatgttagtgaggacttttgcacacaagtgcatgcacacttggcatacacacacacacacacacacacacacacacacacacacacacacggacttcttggaaactgctttatgaagaaactgctttatgaaataagcaaaattctcaagtgcacagatactagcagttatgacagtaatacagcgtcttctgtgaccctcactacctgcactgcttgcatccctgctttatgcctggtggcacattattcacccggtaacctccagctgctttgatcctgtttcagtcaaagtcagcttcagccaccccctccattccctagccagctccacccttgatgaaactgtggctaatgttccttcactaggacaggcaccatgagtgtgtttctaagttccagagtctgtggggaggatggtgggtgggcagccagccctgttgctatgttgcttcttccacaccccctcaagacaggtgcataggtggcactgggaacatcctacgcagggacaacctccaaaattaatgggtgaacatggtttttttggaatcaactgagataatgctatttcaatagcggctggctttttgtgattcagtaacttaaatattgccagtgactgaggatcccctccagtcatggtt

SEQ ID NO: 17624 - DNA, 1134 bp, Mus musculus
gttcgaccttaaagcctttgggctaacttaagtattactatttgtatttaaataattacatggtgggttttagaaaggctggctgtcctgcccctttggtgttcatatgcattccccagcctgatgctttaaaagccttgccactgccctgcttgtggacactaatcatctctttttcttgtatccagagtgactgtgattcaggtaattgagcaccatgattggaaaaaagattttaggtttatttcccctccatttttatgtgtacattttgttgtttcattcagaagttggatttactttacaaaatgacttaattttcatattgtggtcatgtttgtgtaaacttcaaactattttgttaatttttggcacttcctatatataattctagtaatgcttgaatgtacacttaaatatgaagtaggattaagtcagctgctgtgtttaaagaatgctgttaagaacaagcattcaaaactgtataggaaggtattagcttaagagtaggtaagataccgtgactgtatctgcagacaagaagaggaaagaaaagctttgccagtttgtggatttatcttaattcccttcagtatattcaatctcttttcaaataaagctctttgagaagtacccagtattgttgggtttaatttttcctactattattgattcttgatattcaagcatttacatgacagcgtatttttttcttttccttttttctgtttatttttttttgctatcattaacatttcatttgaaatgcatactcttcttgaaatattttgtttttagcataaatgttgtgcattttatcttagtgtttggattaaaacatttgtgttgttgagctttcttcatttgctttgtatatttaataatgtatctttattttccagtatgcctattttttgtattgtacaataaatttattttaagctgattttattgttttttttaatatatatgtaaaaacacctgtgatatttaaagtacaaaaaaacagcaaaacaaaacacttggggttttaacttagaaaaaaattatcttatctgaaaaaacatacctttatgaagattgcctggaaaagaaactagaaaccagaaagtcttcatttgagttttaactttt

SEQ ID NO: 17625 - DNA, 1218 bp, Mus musculus
cgtattggaggtggtcgtagaaaagcttcaaattgtctttataacaaaaacaggttccatttattctttcagaaaattctgtttatgcttaatttatttaaaaatgtccttaatgtgtgaatgttttgcctgcttatatatgtgtgctataactaaaatcctcgcagaccagaagaaactgttgtattcctcacactggagttacagacagttgtgagctgccatgtgggtactaggaatcaaattggggttctctgaaatagcagtcagtgctcttaactgctgagtgttttactttcccagattataatttattttcagtcttcaaaaacttagcaatagaaattacaactaaatttctattcctgtcctgatgtcagtcctcttcctgtctctttggtctgttacactagtctgcaagtagttgctagaggtggtggtgaagctacacaggataaggcgtgatctgttgaaatatgaataaaccagtgaatatctgatttcttacatgtattctgtgtaactctttacaggatcttgtttctctgtgtaacttccataactatgataatttgagacactttgcaaaaaaacttgatcctcggagagaaggaggtgatcaaagggtaagccagtccttccttagatccttctcagtgtcctctaagatgagcaagcagccctcctgcttacgtaaacgtcagcttgttaacagcctcaagtctttgccaattccaaataagttatttttattgtccgtcatagatactaaaatcatttgtaatatttaaacaaaattgttagcttagcagtgctggttttaaagctaaagccttgtttttactccaaatatttgtcagttattgttcgggattaaatttagctcattgtctagtttgtgcatggatatgtaaatagataggttcataagactaaataagaaaaaggccactggagataacagtttttccagaatgtttaatgatatgattttgatggtggtaataagaaagctgtactactatatgctaaatacccgtaaggtcttgtttattatcacagtgtgtggccccatgtgcataaacatttctttttttttttaagagttagtcttaagatcaagacttgagtttgtttttttcattgggccaaaggacttgctgttgaaaattttaactctattcttttacatcataaaattaccttgtacactagaaa

SEQ ID NO: 17626 - DNA, 1181 bp, Mus musculus
aagcttattctgcagtttttaaagtgataaactatcattatctaaagttttatctgacaaaccactttctgtaaataattggtatgttattatccactgattttgacagctggttcaatttttctttaaatattgggtcatcagtattattggactcttgtttaaggctgttagatcaggataaaacctagaaaacatgattgtgccttgtaagaatagtaactaggcagcaagtcagaggactagtggtgcggattccaggttcagcaaatagacgttcatttctgctgttgtgcagccttgggacgactcgtaacctcttcgagcttagtttctttctccatctgtggagacaagatagtgtcagcaagtaaatttctttagtaccagaaattatggcatatttctgtcaccagatcattaaattagaatggattaaattagaatgtttataaaacacttagcacagtagtaattttcagttaattattgtaggtttcttttttaaagttgtctaaggtcaaagatatgtcaggatatgtcattagatttttataaaggttaatttttaaacatactaatgttgataagtgttcttttagggtgggttttttttttttctgtttgtttggtatttttgtttttttaaattggggccagtgaggtgaggtgatggcttaactgataaaagcacctgccaccaaagcccagacacctgagtagagtcattggcacccacatgaagggagagaactgactcctgaaagttgtttcagacccttcatgccccacgcctacttgtatttactaaaaaaaaaattttctaaaaaccttaaaggttggtataacagtgttttgaaaacaaatatagatattaatgcaatattaatatttcttttaggagaaattctatgttttatgtataaatgtacatgcttatgaattagctattttactgccttttataagaggtgtgtatgtgtgcatgtatttggacatctaaaaaggtcttttcaatagtacagaaacaattatcaacagacatgatccatttgttgttttttaaacaagaataatatacataattcacccatgaaagttgctattatgactattccagaattgatggtatttaaaaatgagaattcttcatcttattgcttttctgaaataaacaaaca

SEQ ID NO: 17627 - DNA, 1179 bp, Mus musculus
cttcaatggagatttcaacaaaaccaacagccatacttcctgctcttggggtacaggacaaaaactgaccctgactgaagtatccgcgaggaatccaggtctctgtataggtaccccaccttccactcacaaacacctatgcggacaaattcagtccgtgtccagaacagaagctaattactatcttgtaccttccccggttggatggtgggcttgcaatacaagacttactccctgtgtatcagctaaggtttttaattcatctcatgatttttgtgtcatgatccagctgttaccccgcgtatattatcaccctgcatccagtttaaaagaaagctatgctggccggcggtcaaaaagagaaccaattactttaaccctggctgcattcatgggaataggtatggcagtaggagtggggacgggagtgtcagctttgatagaaggaagacagggaattcagtctttgagggatgctgtcaatgaagacctagcggcaatagagaagtccattgacgctttagaaaaatctttgacctccctgtctgaggtagttttacagaacaggagaggtcttgatttgttgttcctaaaggaaggaggactgtgtgctgcctttaaaaaagagtgctgcttctatgcagatcatacaggaatagttagagactctatgcagaaactgagagaaagattagagcgaaggaaacggaaacgggatgctcaacgggggtagtttgagtcgtggtttgaatcacgaccatcttggataacttctttaatttccgctgtagccggaccaatccttatgatatgcttagctttagttttcggcccttgtataataaatagaggaatggctttcatccagagtaaaattgatacagtaaaactcatggttcttcaaaggcaatatcaacctatagttcaggtagatgaagagttaggggacaccaatctctaaaattctatgattagaattagtctaaacagaagaagaggggaatgaaaggaaataaaactgtaattcatgtaatgtatgttaaatagcccaaagagttgtttctgagctttgaaacctggggctgagaacatagcagaacagaccaggacatgcccgggcaggcccatcgcctccctatctcccacccctctgacctaagttaaatgttacaggctgct

SEQ ID NO: 17628 - DNA, 1651 bp, Mus musculus
tttagaaaagttcactgaactttgtacatctctagcaaatctatttttatatgcatatagtatatagtgagcatagttctttgggacgcaaagctgttgctgactactgcatactgagttgagctttaaaatgtctttgatgcaatgggctgtgagaatgagcagaagtgagaggctatttcaaagactccaagcaactcagtatcctaagacatgacagacaaggccttcctaagcagacccttctatagcagcctctgatgctggattttaattagacttgggttctaattagctaatggaattaaaaaaaaaaaagacaactcaccagattcctaagtgttaagctaaagagtactatttacaaacagcaggataagatttaagtgcctgggggagggacatgatgtttaaaacttacatagtaggtctgttttgtttgtgaaggagtaagtagggaaccaggaatgggaattctgggaataagaatgactttctaaagacttaagacaagaatcttagaatattcttctcccccaaaccatagtcatacactgaaaacttttgggtttgagctacaaactacaccaggtaccaccccagatagagggtgtcttgggtgactgcatgtagagcttgctcctagaaggaaagcagaggctgtaagaagccaagggatgcctgcctatatggaagggggatgctgctgtggttgaatgggggtcagtcatattgtggatggacaccagaatggttcgaaatggaagctcaccctagcctctaacataggagacaggatcagctgtacagtgaaggcctctgtgtgaccgttctgcctgcccctgcctcgggaggaaacattctacacctggatgcctagcttcactacaaaacacagcttggaatgatgggaacaattaagctgatggttacttttgcacttgaatggtactgcactgtcaacccccaaggctcattttaagtgacctttaaaatcagatgtatttattatgctcgtgcaattacagaaatgaagtgggagacaggctgagccccacctatgaatgtacagtatgtggattgtgaaagtgactgtagggaatcagagcgttgtatcttgtgtttacaattctggttgatttctttgaaaagctgctggtttgggaaatgcacagtgggtgtattgaaataaaaggtaaataccatttttaaatatttcgtaaatgaaaaacacgtgaccaaacaagagaacatcctctgctctgtaatgaatgacaccaaattcaatatgccttcgttacaaaatgtttactgtgagcgtcgatccaacagtgcagtaatttctagccttttgagctgacaccttcacgagtttgtggactttgtgactttttcttcctgttcttacagtgccatatgtcacttgaaaaatattaaagtgaattccaattaaacttgatttgagaattttataacctctcttgagatccttagaaatactcagggatgtcaaagctgaggctaggaatcactaccatagtgatttgtcctgctcctctctgcctgcaggaagttatgctaccctagagttctgtgtgaacccaacttggctcgatgctattaactagactattctttttttttaattagg

SEQ ID NO: 17629 - DNA, 1835 bp, Mus musculus
cagagaggttgttaatattagtgacagccatcattcagatacccattcattctgttagtttcacacacagtgctccattacactggtgattggacagctcacagaactgcaagcaaccactcctgctcctatgccttccatttagttcatggagcagtgtagtttccaatgtctatactgatgattcaggcaaaagcccctaggtcatgatgtttctcattcaattggtttctcatatgaagatgcctgttgcaaagtttcttgttatttgacaaatataattaagtatataaaataatatatatgttggtcagaacataaagacaaaatctacacagagatattggcaagtgggtacgggttgagcatttcaacttcaggtttcttctttgtctgagggttgagcctgcccagtccacatctacccagatgtctgctctctgttgcccctatgtttcacaactatagtttaagcaactatgatcaacagtttcatctcatatatatatatattaaaaatgttatcatactctaagagacctactttaaaatgtataagaactgtacacacacagtaagtagtggataaactgtgtgataaaataattgaacaaactttataccacattggacagtatcaggatatagtatagtttggccttgatgagaattaggaacctttcatgaggaatcagccctttttaatggctttatcttcaaacaactgagtctcgtttgcggtctttcattaaggagtagaggagtgaggagggtcccataaaacagatcactgaacaactcgttacctgctggacagagacacgtggaacatgtctaagggcacgagacctcccagtggcaactgcagaagtagaagtagaacatgtcctgttccttacttagactctcaaaatgccagtgtgtttcaccgcccttccctgctgtctctttggtgttgttgccttttgattacaagccttggatgctggtggaatcttagttgccttatcagttctttacaatctacctatggttattatcacttaaagcacaattttgaaggagacaaatatgattatcttaagcccaaaggaatttgtatcaagctgtctcaaacattaaaagtaaatgtacaaaaatcccatgatatgcagatcctagttaatcatcagcattggcatttgggaccgagtacacttctgaattacattattttggaaaccaggggttagatatgataaataatgtaaaaaaaaaaaaagtaatgtaccatagagcgtctatggtacattaaacgacccaggtatttcttccttggagccataaacactagctctaaagaattagctaccactttagtccccaaactcaagttttgttggcaaacttccttcactgtaggagttaacattgaagaggtatttttttcccagatatttttgtgaaaatggttttgttgtttgttttgggttttttgtaactataataaaagtctaattgcaattttctctcagtcctcatttaattgaaacaaataacttttggtgtggtccactgatgtttcacataaagattctattctgtattgctaaaatgtactaaatgaatgagtgtgtatctgtacagataaactcttgggttattttttcatcatttttattagatatttcctttatttatatttcaaatatcctcatttccctccaacccccccaccaccatcccaacccccctacctctgctcactaacctacccactcctgcttccctgtcctggcattcccctacactggagcattgagccttcacaatgccaaggcccctttcctctcact

SEQ ID NO: 17630 - DNA, 1173 bp, Mus musculus
tgctgtgatcggtgccctgatccttgaattcgcagaccgtctggccagtgaaattgtggaggatgccttgcagcagtgggcatgtgaaaacatccagtactacaacatcccatacatcgagagtgagggctcagacaccaccattaattgatgatactcaactgtgctctggatgtagtcggtgctagttaaatacataagttttcaaattcccatgtctatgatattaatgtaaggatgcttatgaggaaatataattttaagcaattctactattttatcaccaatgtatatctgcttgactcaagttttggtcacagaaggtctggaaagaggtcttgtgccacccagccattagctgtctgtcataccatgctcttcctggggcaggaatgacatcgccaaagaaaatattaaataaaaagtgcccaagttccaaatggttattttaaagggttgactttaaaatgactattttgttgatttatgccaaaaaaaaaaaaaaaaaaacaacataaaacaaaacaaaaggcccagaacatgaaagggaatttccttagaatgtaaaaaaattgaggagtagaactccagccatagtgatccatagcatgtctgttgtcaaaacctactgtgtcagggattgcccacttcctgacacctataacctaccattggagaggtaaaccaccagtggagagggctgccttgaatgtcgttctcagtaggaagtctatttttgtagatgtaaagggtagcaaccaccctcagcctcagggtcatgccacagctgtttctggatgatttaaactttgcatgttacagccatctttacagaatctttatagaagtcatgatagtttatcacattgaaataagaatctctttggtaccttttattcagtaaatcttaacaatgacagaaatttagtctgcaaggtgaaactttgagcctggttttcatggctaacaatgtataaggcctcactgcagtgctggtacaggggtagatgtgtacatggtatgaggacttgcaattctcctcccaaagggaccacctgtgtgcgaattagcagtcactcatgcccccagaacactcttagccacatactctactcctgaatggagaacttgtgtgggttttagcagtcatgaatgcccacagaatacttttag

SEQ ID NO: 17631 - DNA, 1177 bp, Mus musculus
gaggctgaatcctgaggggaaatgatgcaaatgaaagagaaatgaaagaatagacagtgggagcccagctaccagagaaagctccagacgcagtccagtcgtttctcttctattgctgttttgacccctcccccatcttttactgaaggtaacaaaacaacataaactagtgggtaaactgtccacctctttttaaagatccgtcactgcccgtatatatgagatggagatttttggcaaaatttcagggggataatatagctaagcacgagtcaagaaaatccgtttttcctttgaaaggggttttatttcctgacacagctatcttgtatgtatggatgggaaatggtattaagtatagcagaaaggttctgggaaaaatagtaacttcatatttactcttttctttctttttttctttttgctgtgtaagaaaaataactgtaggtacattatgagataataagggtactttaaactgtggtctgccctcaggcaatttcagtatgctgtccacacagcactgctgccagaagccaggttctgattggccacttcagtgtgaggaactcagtgtttggagttatatcctgctcctgtcagaaaagccgtgtttacactgagctgacttctgcttgtgtctcctcagtcctgccccagccaacaacctttcaacttccaagattacattcaggatgtctacttctctttgaaaagaaagtctaaaactttaaatttggagctcactccctaaaaaaaagtaaagaaaagaaaaagaaagaaagcagagaagacagtagagaaaggaaagatgtgtggtgatagagtttctgtctgctttagctggctgctgtaaggatgaaactgttaacccacacagtgcatacaggtgctcgggagacagaatgttttacttttctttaatgagtaaccaaactcgagttaaacacatcagcttatcctgaaaccatcaagcaaatactctgagcttgactaaaaactcatacgtccctgttgttgtcaagctgactttcttcctctttaatctgtgcagcttggtggttttgagggggaacgctttctctcttggtttatattactttaaacctctaacttccactttaatgcatccatcccagctttgattctgacattcattgtgtcaattctacacatc

SEQ ID NO: 17632 - DNA, 1209 bp, Mus musculus
tcctggtggaaatgctataggtggagaggcactacccatgtctgtggacacagattcccttagactctcaagtcaatttctttagcctttccttttggtttctgatacattctatctcatatccattaaaaaacaaaacaaaacaaaacctggaggctttttattcctgctaaattttgattgaaatccactatttcaatcaaaatttaaagtaggggttagacaatctcacaactatgctgtgatagatgatgatctgctaagctctgacagatgtaaactgtcacaaggaaagccatcctataccccactttttaaagcatgtttaattttaagctgaatttgtactagaagtcttctggaagccaacctaaacgccatagctattctttaagtagaccagttctttaataataaggaacttgaacgtgcaagtataattttgtgggtaccatttatataaagatgcttaataccaataactggcaatccaattaatcattaaagctagacttacctgatttttaaagtactttctgttagatattttaattgttttctaatttagatcatagagatgaatgacaagttaagaaacaggcaagaaattgtgaatggactgaacatatttttggaagaaaatggtatgtttgcttaagtgaatttacatttctttaaaacttaagaacatgttatttttaaaagaactgttctgtttttaacctgctttcgattcatctacagatagtgaattcccgttgtttaaaaatcaaaaccaccccagggctgtaactgccaaagtgacctcaagtcgccatagcaaatttatgtctctacatagacatcaacacacatttgtaaggtgtttatgacctactttaaagttcttttcaccttttccttgtatttcgacttagctttcttggtcatataaagaaattatagtattataggttatacactttatcacatacctagagatgataaacaagatttttttctctttataaacagctttctgtctgtctctgtctccttctctgcctccctctccctctttctttctcttccctgccccacaaagtctatgtaacccaagctagaccacaatcctgcttcagcatcccaggggctaggtgagattcccaatatgctctccttaacacatgcacataacttttatattatctgagattctattggatcagt

SEQ ID NO: 17633 - DNA, 1187 bp, Mus musculus
gttaaggggtggcctgtcattctgcctggtcatttcaggtaaaaatgacattaattttctattcataaatagtatagtctgtaatttgtcatgtagcagtcacagaatattatgagttttttaattgaaaaatatttcatacagtgtattctgacgatggtttcccctttcccagatcctccctacccacccaacctcacacaacatgccccctttctccatttcagtctcctgctctctctagctcttgccgtgctctcactctttaaaaatacaaagagtcaagaaacacataaatacatcacataaaacacaaaaccaaaaaccaaaatatacacacaaaaatactagtaagatcaaaaaatacccagtctacaaaattacccttgagatcgttttttgtgttagccatctcctgctgggcctggggcctgccggaagtgtagttaatatatacccagtgagacaccattggagaaaactcattttttttttcctttgcaagcagatgtcatttgtggatggcttcctgattaagaataagcagccatgtccataacgccctctcagtgctgggatcgcatctgtcttgaacctgtgcaggccctgtggatgctgaattcatgtgttcttcagtcctgctgtgtctggaagatgctgttagcgtagagtcatccatcacctctggctctgactgtctttgggtctcctctgcatagacatcccatttaggactgagtcctccaaatctcactccctgcacactgtccagttgtgtgtctctcttagttgccatctgcggccttcatcatagagtcggtgccttttatcccattaatcagggcaatatggagagtgtgaaaacacttagcagttgtctgctatacaggacagaaaattgcttccttatataaaaccagaaagtttttaaggaattatcacaaaagaaggaacatggtattgccaaggaagaccctatgacatgggtagaatgtgagagtgtgataaagaaagatggggaaggggtggtggccaggttgaggatagctccgcaggccccaggattagccagaatctttgtccctgctgagaaagtaggggttagtgaagacttaggtcttttctgattttctctcctttactctagagggtcagaatccaggtgtgagccatgaacctccctgcca

SEQ ID NO: 17634 - DNA, 1195 bp, Mus musculus
gtctcccaaccaaaaaaagcccaggaccagatgggtttagtgcagagttctatcagaccttcaaagaagacctaattccaattctcctcaaactattccacaaaatagaaacagaaggcactctaaaaatatgttttataaaggtaaaaaggaaggacttgctaaaaatcaagctaaataaggatgactgctggattcttggtgagatcagggtgggttttgcttgttaccgatagtgttttgttttagttcatttggaggatgatatatataaaagctatgtcagaatttttaatttaattttaaatataaatgatcataaatacctatgctagtgagttaattgaatcctcatataatagactgacctccttgtgttagagttaagtcaagatccagacaaaacaagtactgtattgtacgatacctacataggagttagcagagctaaagaattgacactcctgtgtgcatagtgtcaacttttccttcaagttgtcagataaccagattgtttaccttgtgttaaatgtgactgcagcttaatgttctttttataggagaactatggatttgataaaattgagattcgggacaatggtgagggcatcaaggctgtagatgtccctgtaatggcagtgaagtactacacctcgaagatcagcagtcatgaagaccttggaaatctgacaacttatggttttcgtggtgaagccttggggtcaatatgtaatgttgcggaggtaaggaagtttatattgacttttgtttttattaacttctcaatgactaaatattagaattaggagaaaatcaattcattgtttgtcagagtagcttaaaatatttttttttaccttatggtaaaatacactgaatatgaaatttaccatttttacctataatttggtggtattaggtatatctacgttgtgtgtttatcaatttgtacttgtttctgggttattttcctcttcctaagttacaactcaatacccactataaataaagcgtgctttctttcctcctcttctctgtcaggtcctgttcgactttctagctctacaaattggcattaaaggtacctcataaaagtggaacattcatgtctggcttattttactttatataatgtcttcaaggtttgtgcccattgtgctgtaacactcgaaggacctcctgaaccaggtgtgtt

SEQ ID NO: 17635 - DNA, 1554 bp, Mus musculus
ttggtatatttctgagagaggctttgcaggcaggctgggcaggcccagcttataacttgatggtagtaggataagagtacagtaactaaatccaaggaaatgtgggatttgtaagaaactaggtccagcttatagtgagcgagcattatgttagggaaagagcattccaatcattcgttcatagccggttgaagcagacttctagaaagcagaacctcctgtgtacatgtttttattactgtgcacagtctgctttgtatgacatacacctgatatatgtcctcaggttcctggcttagtatcatgcattgataaatgaggtactgtttgcatttattacattacagggtttgtgagggttttgtcttcatttcttgctctaagagaagaagataggcatcttacagtcaaggctctgagtcaacgtgctcattttggaacaaagtaggttttactgcttttccagaagcaaagctgccaaaccaattaagagaataacttacttcaagcacttcaggtcttgagtagctgaaaattattgtttagttggttaagtcttttctttcttctaaaaaggaaatgcaagatggggccggctggtgtggggagacctaagtaaagagtcctctgtcagcaatgttatctgaagtaacagataatattgtctgctcttagtctcttactctccatccgcacagtttggtttgcccattaatatttcctgtaaatgtgtcagtcttagtgtagatgacccaaaatggtacctatattcacagcaacaactatattgaattcttgtgacttggggaagcttcctatagttgctagcattcattaattgtataaagagaagtaaatacctttctaaaatgatataaagctgaaaaactcagtaacttaagagtgaagacagttgtcaaccaacttacaaatcgattgtggcaatacacagagttaagggtagtgatcattgtttcatatctcaaaagtactgaatttagaaatcacttgtttgataccccctttgtatgtttgccttttcttgtgtatctttaaataactggtaattgatgctttaataaaagttttctttggtgtaagattattttaagttttccaagacagtcatcacaactacactgacacttttcagatttataaaattagctaaaaatgttcctctgtttaagtacatttttttctttattcttttcttttaaagacagggtctctgtgtatagctctggctgtcctagaacttgttccgtagacgaggatggcctcaaactcagtgagatccacctgcctttgtctcctgagtgctagtattaaaggcatgagctttaattaatttaactgcccagtttaacttcatttttgaaaactagttttttgcacatactgtacaaataggaatttctcttcccattttctgtgctttctactttgaatgctttaaaacatatttattcgtagctatatgagggtttgcttggttatgctgttttaggctacagagtttgtaaagaagaaaaatgtgtgccttctgtagag
